US010724025B2

(12) United States Patent
Nazor et al.

(10) Patent No.: US 10,724,025 B2
(45) Date of Patent: Jul. 28, 2020

(54) PENICILLIN-G ACYLASES

(71) Applicant: Codexis, Inc., Redwood City, CA (US)

(72) Inventors: Jovana Nazor, Santa Clara, CA (US);
Vesna Mitchell, Santa Clara, CA (US);
David Elgart, San Mateo, CA (US);
Katrina W. Lexa, Westfield, NJ (US);
Nikki Dellas, Mountain View, CA (US);
Robert Kevin Orr, Cranford, NJ (US);
Oscar Alvizo, Fremont, CA (US); Ravi David Garcia, Los Gatos, CA (US);
Judy Victoria Antonio Viduya, South San Francisco, CA (US); Courtney Dianne Moffett, San Francisco, CA (US)

(73) Assignee: Codexis, Inc., Redwood City, CA (US)

( * ) Notice: Subject to any disclaimer, the term of this patent is extended or adjusted under 35 U.S.C. 154(b) by 235 days.

(21) Appl. No.: 15/588,378

(22) Filed: May 5, 2017

(65) Prior Publication Data

US 2017/0321202 A1 Nov. 9, 2017

Related U.S. Application Data

(60) Provisional application No. 62/332,103, filed on May 5, 2016.

(51) Int. Cl.
*C12N 9/84* (2006.01)
*C07K 14/62* (2006.01)
*C12P 21/02* (2006.01)

(52) U.S. Cl.
CPC ............. *C12N 9/84* (2013.01); *C07K 14/62* (2013.01); *C12P 21/02* (2013.01); *C12Y 305/01011* (2013.01)

(58) Field of Classification Search
None
See application file for complete search history.

(56) References Cited

U.S. PATENT DOCUMENTS

| | | |
|---|---|---|
| 5,605,793 A | 2/1997 | Stemmer |
| 5,646,242 A | 7/1997 | Baker et al. |
| 5,811,238 A | 9/1998 | Stemmer et al. |
| 5,830,721 A | 11/1998 | Stemmer et al. |
| 5,834,252 A | 11/1998 | Stemmer et al. |
| 5,837,458 A | 11/1998 | Minshull et al. |
| 5,928,905 A | 7/1999 | Stemmer et al. |
| 6,096,548 A | 8/2000 | Stemmer |
| 6,117,679 A | 9/2000 | Stemmer |
| 6,132,970 A | 10/2000 | Stemmer |
| 6,165,793 A | 12/2000 | Stemmer |
| 6,180,406 B1 | 1/2001 | Stemmer |
| 6,251,674 B1 | 6/2001 | Tobin et al. |
| 6,265,201 B1 | 7/2001 | Wackett et al. |
| 6,277,638 B1 | 8/2001 | Stemmer |
| 6,287,861 B1 | 9/2001 | Stemmer et al. |
| 6,287,862 B1 | 9/2001 | delCardayre et al. |
| 6,291,242 B1 | 9/2001 | Stemmer |
| 6,297,053 B1 | 10/2001 | Stemmer |
| 6,303,344 B1 | 10/2001 | Patten et al. |
| 6,309,883 B1 | 10/2001 | Minshull et al. |
| 6,319,713 B1 | 11/2001 | Patten et al. |
| 6,319,714 B1 | 11/2001 | Crameri et al. |
| 6,323,030 B1 | 11/2001 | Stemmer |
| 6,326,204 B1 | 12/2001 | delCardayre et al. |
| 6,335,160 B1 | 1/2002 | Patten et al. |
| 6,335,198 B1 | 1/2002 | delCardayre et al. |
| 6,337,186 B1 | 1/2002 | Krebber |
| 6,344,356 B1 | 2/2002 | Stemmer |
| 6,352,859 B1 | 3/2002 | delCardayre et al. |
| 6,355,484 B1 | 3/2002 | Patten et al. |
| 6,358,740 B1 | 3/2002 | Patten et al. |
| 6,358,742 B1 | 3/2002 | Stemmer |
| 6,365,377 B1 | 4/2002 | Patten et al. |
| 6,365,408 B1 | 4/2002 | Stemmer |
| 6,368,861 B1 | 4/2002 | Crameri et al. |
| 6,372,497 B1 | 4/2002 | Stemmer |
| 6,376,246 B1 | 4/2002 | Crameri et al. |
| 6,379,964 B1 | 4/2002 | delCardayre et al. |
| 6,387,702 B1 | 5/2002 | Stemmer |
| 6,391,552 B2 | 5/2002 | Stemmer |
| 6,391,640 B1 | 5/2002 | Minshull et al. |
| 6,395,547 B1 | 5/2002 | Stemmer |
| 6,406,855 B1 | 6/2002 | Patten et al. |
| 6,406,910 B1 | 6/2002 | Patten et al. |
| 6,413,745 B1 | 7/2002 | Patten et al. |
| 6,413,774 B1 | 7/2002 | Stemmer |

(Continued)

FOREIGN PATENT DOCUMENTS

| | | |
|---|---|---|
| EP | 137280 B1 | 3/1992 |
| WO | 95/22625 A1 | 8/1995 |

(Continued)

OTHER PUBLICATIONS

Alkema, W.B.L., et al., "The use of chromogenic reference substrates for the kinetic analysis of penicillin acylases," Anal. Biochem., 275: 47-53 [1999].
Altschul, S., et al., "Basic local alignment search tool," J. Mol. Biol., 215: 403-410 [1990].
Altschul, S.F., et al., "Gapped BLAST and PSI-BLAST: a new generation of protein database search programs," Nucleic Acids Res., 25(17):3389-3402 [1997].
Barbero, J.L., et al., "Complete nucleotide sequence of the penicillin acylase gene from kluyvera citrophilia," Gene, 49(1):69-80 [1986].
Beaucage, S.L., et al., "Deoxynucleoside phosphoamidites—A new class of key intermediates for deoxypolynucleotide synthesis," Tetrahedron Letters, 22(20):1859-62 [1981].

(Continued)

*Primary Examiner* — Anand U Desai
(74) *Attorney, Agent, or Firm* — Codexis, Inc.

(57) ABSTRACT

The present invention provides engineered penicillin G acylase (PGA) enzymes having improved properties, polynucleotides encoding such enzymes, compositions including the enzymes, and methods of using the enzymes.

12 Claims, 9 Drawing Sheets

Specification includes a Sequence Listing.

(56) References Cited

U.S. PATENT DOCUMENTS

| | | |
|---|---|---|
| 6,420,175 B1 | 7/2002 | Stemmer |
| 6,423,542 B1 | 7/2002 | Crameri et al. |
| 6,426,224 B1 | 7/2002 | Crameri et al. |
| 6,436,675 B1 | 8/2002 | Welch et al. |
| 6,444,468 B1 | 9/2002 | Stemmer et al. |
| 6,455,253 B1 | 9/2002 | Patten et al. |
| 6,479,652 B1 | 11/2002 | Crameri et al. |
| 6,482,647 B1 | 11/2002 | Stemmer |
| 6,483,011 B1 | 11/2002 | Stemmer et al. |
| 6,484,105 B2 | 11/2002 | Zhang |
| 6,489,146 B2 | 12/2002 | Stemmer et al. |
| 6,500,617 B1 | 12/2002 | Stemmer et al. |
| 6,500,639 B2 | 12/2002 | Subramanian |
| 6,506,602 B1 | 1/2003 | Stemmer |
| 6,506,603 B1 | 1/2003 | Stemmer |
| 6,518,065 B1 | 2/2003 | Stemmer |
| 6,519,065 B1 | 2/2003 | Colbourne et al. |
| 6,521,453 B1 | 2/2003 | Crameri et al. |
| 6,528,311 B1 | 3/2003 | delCardayre et al. |
| 6,537,746 B2 | 3/2003 | Arnold et al. |
| 6,573,098 B1 | 6/2003 | Stemmer |
| 6,576,467 B1 | 6/2003 | Stemmer |
| 6,579,678 B1 | 6/2003 | Patten et al. |
| 6,586,182 B1 | 7/2003 | Patten et al. |
| 6,602,986 B1 | 8/2003 | Stemmer et al. |
| 6,605,430 B1 | 8/2003 | Affholter et al. |
| 6,613,514 B2 | 9/2003 | Patten et al. |
| 6,653,072 B1 | 11/2003 | Patten et al. |
| 6,686,515 B1 | 2/2004 | Lassner et al. |
| 6,703,240 B1 | 3/2004 | Stemmer et al. |
| 6,716,631 B1 | 4/2004 | delCardayre et al. |
| 6,825,001 B2 | 11/2004 | Wackett et al. |
| 6,902,922 B2 | 6/2005 | Ness et al. |
| 6,917,882 B2 | 7/2005 | Selfinov et al. |
| 6,946,296 B2 | 9/2005 | Patten et al. |
| 6,961,664 B2 | 11/2005 | Selfinov et al. |
| 6,995,017 B1 | 2/2006 | Stemmer |
| 7,024,312 B1 | 4/2006 | Selfinov et al. |
| 7,058,515 B1 | 6/2006 | Selfinov et al. |
| 7,105,297 B2 | 9/2006 | Minshull et al. |
| 7,148,054 B2 | 12/2006 | delCardayre et al. |
| 7,220,566 B2 | 5/2007 | Ness |
| 7,288,375 B2 | 10/2007 | Stemmer et al. |
| 7,384,387 B1 | 6/2008 | Raillard et al. |
| 7,399,627 B2 | 7/2008 | Emalfarb et al. |
| 7,421,347 B2 | 9/2008 | Selfinov et al. |
| 7,430,477 B2 | 9/2008 | Selfinov et al. |
| 7,462,469 B2 | 12/2008 | Bass et al. |
| 7,534,564 B2 | 5/2009 | Patten et al. |
| 7,620,500 B2 | 11/2009 | Mundorff et al. |
| 7,620,502 B2 | 11/2009 | Selfinov et al. |
| 7,629,170 B2 | 12/2009 | delCardayre et al. |
| 7,702,464 B1 | 4/2010 | Emig et al. |
| 7,747,391 B2 | 6/2010 | Gustafsson et al. |
| 7,747,393 B2 | 6/2010 | Fox |
| 7,751,986 B2 | 7/2010 | Gustafsson et al. |
| 7,776,598 B2 | 8/2010 | Patten et al. |
| 7,783,428 B2 | 8/2010 | Gustafsson et al. |
| 7,795,030 B2 | 9/2010 | Minshull et al. |
| 7,853,410 B2 | 12/2010 | Selfinov et al. |
| 7,868,138 B2 | 1/2011 | Stemmer et al. |
| 7,873,477 B1 | 1/2011 | Gustafsson et al. |
| 7,873,499 B2 | 1/2011 | Selfinov et al. |
| 7,904,249 B2 | 3/2011 | Selfinov et al. |
| 7,957,912 B2 | 6/2011 | Selfinov et al. |
| 7,981,614 B2 | 7/2011 | Stemmer et al. |
| 8,014,961 B2 | 9/2011 | Bass et al. |
| 8,029,988 B2 | 10/2011 | Crameri et al. |
| 8,048,674 B2 | 11/2011 | Minshull et al. |
| 8,058,001 B2 | 11/2011 | Crameri et al. |
| 8,076,138 B2 | 12/2011 | Delcardayre et al. |
| 8,108,150 B2 | 1/2012 | Mundorff et al. |
| 8,170,806 B2 | 5/2012 | Selfinov et al. |
| 8,224,580 B2 | 7/2012 | Mundorff et al. |
| 8,247,192 B2 * | 8/2012 | Behrouzian .............. C12N 9/84 435/230 |
| 8,377,681 B2 | 2/2013 | delCardayre et al. |
| 8,383,346 B2 | 2/2013 | Colbeck et al. |
| 8,457,903 B1 | 6/2013 | Emig et al. |
| 8,504,498 B2 | 8/2013 | Fox |
| 8,569,013 B2 * | 10/2013 | Behrouzian .............. C12N 9/84 435/230 |
| 8,589,085 B2 | 11/2013 | Selfinov et al. |
| 8,762,066 B2 | 6/2014 | Fox |
| 8,768,871 B2 | 7/2014 | Fox |
| 9,593,326 B2 | 3/2017 | Clark et al. |
| 2006/0195947 A1 | 8/2006 | Davis et al. |
| 2006/0264606 A1 | 11/2006 | Kjeldsen et al. |
| 2008/0220990 A1 | 9/2008 | Fox |
| 2009/0312196 A1 | 12/2009 | Colbeck et al. |
| 2010/0143968 A1 | 6/2010 | Behrouzian et al. |
| 2012/0270282 A1 | 10/2012 | Behrouzian et al. |
| 2016/0326508 A1 | 11/2016 | Banerjee et al. |

FOREIGN PATENT DOCUMENTS

| | | |
|---|---|---|
| WO | 95/33836 A1 | 12/1995 |
| WO | 96/00787 A1 | 1/1996 |
| WO | 97/0078 A1 | 1/1997 |
| WO | 97/35966 A1 | 10/1997 |
| WO | 98/27230 A1 | 6/1998 |
| WO | 2000/42651 A1 | 7/2000 |
| WO | 2001/75767 A2 | 10/2001 |
| WO | 2009/152336 A1 | 12/2009 |
| WO | 2010/144103 A1 | 12/2010 |
| WO | 2016/179464 A1 | 11/2016 |

OTHER PUBLICATIONS

Blaiseau, P-L., et al., "Primary structure of a chitinase-encoding gene (chi1) from the filamentous fungus *Aphanocladium album*: similarity to bacterial chitinases," Gene, 120:243-248 [1992].

Boel, E., et al., "Two different types of intervening sequences in the glucoamylase gene from Aspergillus niger," EMBO J., 3:1581-85 [1984].

Botstein, D., et al., "Strategies and applications of in vitro mutagenesis," Science, 229(4719):1193-1201 [1985].

Brtnik, F., et al., "Use of phenylacetyl group for protection of the lysine Nε-amino group in synthesis of peptides," Coll. Czech. Chem. Commun., 46(8): 1983-1989 [1981].

Carter, P., "Site-directed mutagenesis," Biochem. J., 237:1-7 [1986].

Chaveroche, M., et al., "A rapid method for efficient gene replacement in the filamentous fungus *Aspergillus nidulans*," Nucl. Acids Res., 28:22 e97 [2000].

Cho, Y., et al., "A high throughput targeted gene disruption method for Alternaria brassicicola functional genomics using linear minimal element (LME) constructs," Mol Plant Microbe Interact, 19(1):7-15 [2006].

Christians, F.C., et al., "Directed evolution of thymidine kinase for AZT phosphorylation using DNA family shuffling," Nat. Biotechnol., 17:259-264 (1999).

Combier, J.-P., et al., "Agrobacterium tumefaciens-mediated transformation as a tool for insertional mutagenesis in the symbiotic ectomycorrhizal fungus Hebeloma cylindrosporum," FEMS Microbiol Lett., 220:141-8 [2003].

Crameri, A., et al., "DNA shuffling of a family of genes from diverse species accelerates directed evolution", Nature, 391:288-291 (1998).

Crameri, A., et al., "Improved green fluorescent protein by molecular evolution using DNA shuffling," Nat. Biotechnol., 14(3):315-319 (1996).

Crameri, A., et al., "Molecular evolution of an arsenate detoxification pathway by DNA shuffling," Nat. Biotechnol., 15(5):436-438 (1997).

Dale, S.J. et al. "Oligonucleotide-directed random mutagenesis using the phosphorothioate method," Methods Mol. Biol., 57:369-74 (1996).

De Boer, H.A., et al., "The tac promoter: A functional hybrid derived from the trp and lac promoters," Proc. Natl Acad. Sci. USA, 80: 21-25 (1983).

(56) References Cited

OTHER PUBLICATIONS

Ehrlich, S.D.,"DNA cloning in Bacillus subtilis," Proc. Natl. Acad. Sci. USA, 75(3):1433-1436 [1978].
Eisenberg, D.,et al., "Analysis of Membrane and Surface Protein Sequences with the Hudrophobic Moment Plot," J. Mol. Biol., 179:125-142 [1984].
Firon, A., et al., "Identification of Essential Genes in the Human Fungal Pathogen *Aspergillus fumigatus* by Transposon Mutagenesis," Eukaryot. Cell, 2(2):247-55 [2003].
Guo, Z., et al., "3'-End-Forming Signals of Yeast mRNA," Mol. Cell. Biol., 15(11):5983-5990 [1995].
Henaut and Danchin in Neidhardt et al. [eds.], *Escherichia coil* and *Salmonella*, "Analysis and predictions from *Escherichia coli* Sequences, or *E. coli* in silico," ASM Press, Washington Dc., [1987], pp. 2047-2066.
Henikoff, S.,et al., "Amino acid substitution matrices from protein blocks," Proc. Natl. Acad. Sci., 89:10915-10919 (1992).
Hong, J., et al., "Cloning and functional expression of thermostable beta-glucosidase gene from Thermoascus aurantiacus," Appl. Microbiol. Biotechnol, 73:1331-1339 [2007].
Kramer, B., et al., "Different base/base mismatches are corrected with different efficiencies by the methyl-directed DNA mismatch-repair system of *E. coil*," Cell, 38(3):879-887, 1984.
Lathe, R., et al., "Plasmid and bacteriolphage vecotrs for excision of intact inserts," Gene, 57:193-201 [1987].
Limon, C., et al. "Primary structure and expression pattern of the 33-kDa chitinase gene from the nucoparasitic fungus *Trichocherma harzianum*," Curr. Genet., 28:478-83 [1995].
Ling, M., et al., "Approaches to DNA Mutagenesis:An Overview," Anal. Biochem., 254:157-78 (1997).
Liu, S.L., et al. "Preparation of optically pure tert-leucine by penicillin G acylasecatalyzed resolution," Prep Biochem Biotechnol., 36(3):235-41 [2006].
Maruyama, J., "Multiple gene disruptions by marker recycling with highly efficient gene-targeting background (delta-igD) in Aspergillus oryzae," Biotechnol Lett., 30:1811-1817 [2008].
Matthes, H.W.D., et al., "Simultaneous rapid chemical synthesis of over one hundred oligonucleotides on a microscale," EMBO J., 3(4):801-05 (1984).
Mcinerney, J.O., "GCUA: general codon usage analysis," Bioinformatics, 14(4):372-73 [1998].
Minshull, J., et al., "Protein evolution by molecular breeding," Curr. Op. Chem. Biol., 3(3):284-290 (1999).
Nakamura, Y., et al., "Codon usage tabulated from international DNA sequence databases: status for the year 2000," Nucl. Acids Res., 28:292 [2000].
Needleman, S., et al., "A general method applicable to the search for similarities in the amino acid sequence of two proteins," J. Mol. Biol. 48:443-453 (1970).
Nunberg, J.H., et al., "Molecular Cloning and Characterization of the Glucoamylase Gene of Aspergillus awamori," Mol. Cell Biol., 4(11):2306-2315 [1984].
Parry, N.J., et al., "Biochemical characterizatio and mechanism of action of a thermiostablebeta-glucosidase purified from Thermoascus aurantiacus," Biochem. J., 353:117-127 [2001].
Pearson, W.R., "Improved tools for biological sequence comparison," Proc. Nat'l. Acad. Sci. USA, 85:2444-2448 (1988).
Porath, J., "Immobilized metal ion affinity chromatography," Protein Expression and Purification, 3:263-281 (1992).
Romanos, M.A., et al., "Foreign gene expression in yeast: a review," Yeast 8:423-488 [1992].
Sakaguchi, K., et al., "A Preliminary Report on a New Enzyme, Penicillin-amidase", J. Agr.Chem. Soc. Jpn., 23(9):411 [1950].

Simonen, M., et al., "Protein Secretion in *Bacillus* Species," Microbiological Reviews, 57:109-137 (1993).
Simons, H., et al., "Rapid continuous colorimetric enzyme assay for penicillin G acylase," Biotechnol. Tech.,13(6):365-367 [1999].
Smith, M., "In vitro mutagenesis," Ann. Rev. Genet., 19:423-462 (1985).
Smith, T., et al., "Comparison of Biosequences," Adv. Appl. Math, 2:482-489 (1981).
Stemmer, W., "DNA Shuffling by Random Fragmentation and Reassembly: in vitro Recombination for Molecular Evolution," Proc. Natl. Acad. Sci. USA, 91:10747-10751 (1994).
Stemmer, W.P.C., "Rapid evolution of a protein in vitro by DNA shuffling", Nature, 370:389-391 (1994).
Stenico, M., et al., "Codon usage in *Caenorhabditis elegans*: delineation of translational selection and mutational biases," Nucl. Acids Res. 22(13):2437-46 [1994].
Zakova, L., et al., "The use of Fmoc-Lys(Pac)-OH and penicillin G acylase in the preparation of novel semisynthetic insulin analogs," Journal of Peptide Science, 13(5):334-341 [2007].
Takahashi, T., et al., "Efficient gene disruption in the koji-mold *Aspergillus sojae* using a novel variation of the positive-negative method," Mol. Gen. Genom., 272: 344-352 [2004].
Taussig, R., et al., "Nucleotide sequence of the yeast SUC2 gene for invertase," Nucl. Acids Res., 11(6):1943-54 [1983].
Tiwari, S., et al., "Prediction of probable genes by Fourier analysis of genomic sequences," Comput. Appl. Biosci. 13(3):263-270 [1997].
Uberbacher, E.C., et al., "Discovering and Understanding Genes in Human DNA Sequence Using GRAIL," Methods Enzymol., 266:259-281 [1996].
Villa-Komaroff, L., et al., "A bacterial clone synthesizing proinsulin," Proc. Natl Acad. Sci. USA, 75:3727-3731 (1978).
Wada, K., et al., "Codon usage tabulated from the GenBank genetic sequence data," Nucl. Acids Res., 20:2111-2118 [1992].
Wang, Q-C., et al., "Application of an Immobilized PenicillinAcylase to the Deprotection of N-phenylacetyl Insulin," Biopolymers, 25:S109-S114 [1986].
Wells, J.A., et al., "Cassette mutagenesis: an efficient method for generation of multiple mutations at defined sites," Gene, 34:315-323 (1985).
Wilson, I.A., et al., "The structure of antigenic determinant in a protein," Cell, 37:767-778 [1984].
Wright, F., "The 'effective Number of codons' used in a gene," Gene 87:23-29 [1990].
You, B., et al., "Gene-specifc disruption in the fillamentous fungus *Cercospora nicotianae* using a split-marker approach," Arch Micriobiol., 191:615-622 [2009].
Zhang, J-H., et al., "Directed evolution of a fucosidase from a galactosidase by DNA shuffling and screening ," Proc. Nat. Acad. Sci., U.S.A., 94:4504-4509 (1997).
Swiss-Prot Accession No. P07941 dated Nov. 24, 2009.
Swiss-Prot Accession No. P00724 dated Feb. 22, 2012.
USPOP Accession No. AJ036992, Database USPTO Proteins dated Feb. 18, 2015.
Svoboda, I., et al., "Semisynthetic Insulin Analogues Modified in Positions B24, B25 and B29," Biol. Chem. Hoppe-Seyler, 375:373-378 [1994].
Didziapetris, R., et al., "Penicillin acylase-catalyzed protection and deprotection of amino groups as a promising approach in enzymatic peptide synthesis," FEBS Letters, 287(1-2):31-33 [1991].
Virden, R., "Structure, Processing and Catalytic Action of Penicillin Acylase," Biotechnology and Genetic Engineerint Reviews, 8(1):189-218 [1990].

\* cited by examiner

FIG. 2

| SEQ ID NO: (nt/aa) | Amino Acid Differences (Relative to SEQ ID NO: 1262) | A1 %conv.[1] | A1 %sel.[2] | B29 %conv.[1] | B29 %sel.[2] | B1 %conv.[1] | B1 %sel.[2] | A1/B29 %conv.[1] | A1/B29 %sel.[2] | A1/B1 %conv.[1] | A1/B1 %sel.[2] | B1/B29 %conv.[1] | B1/B29 %sel.[2] |
|---|---|---|---|---|---|---|---|---|---|---|---|---|---|
| 1263/1264 | V28A;G74D;Q547K; | + | +++++ | | | | | | | | | | |
| 953/954 | W431R; | + | +++++ | | + | | | | | | | | |
| 955/956 | F701L; | + | +++++ | | + | | | | | | | | |
| 957/958 | F701A; | + | +++++ | | | | | | | | | | |
| 1265/1266 | F701Y; | + | +++++ | | + | | | | | | | | |
| 959/960 | F24A; | + | +++++ | | + | | | | | | | | |
| 1267/1268 | F71L; | + | +++++ | | + | | | | + | | | | |
| 961/962 | F71V; | + | +++++ | | + | | + | | | | | | |
| 1269/1270 | F71C; | + | +++++ | | + | | | | | | | | |
| 963/964 | F71K; | + | ++++ | | | | | | + | | | | + |
| 1271/1272 | F71R; | + | +++++ | | + | | | | | | | | |
| 965/966 | F71E; | + | +++++ | | + | | | | + | | | | |
| 967/968 | F24Y;V28A; | + | +++++ | | + | | | | | | | | |
| 969/970 | M697L; | + | +++++ | | + | | | | | | | | |

FIG. 2 (Cont.)

| SEQ ID NO: (nt/aa) | Amino Acid Differences (Relative to SEQ ID NO: 1262) | A1 % conv.[1] | A1 % sel.[2] | B29 % conv.[1] | B29 % sel.[2] | B1 % conv.[1] | B1 % sel.[2] | A1/B29 % conv.[1] | A1/B29 % sel.[2] | A1/B1 % conv.[1] | A1/B1 % sel.[2] | B1/B29 % conv.[1] | B1/B29 % sel.[2] |
|---|---|---|---|---|---|---|---|---|---|---|---|---|---|
| 1273/1274 | V56T; | + | +++++ |  | + |  |  |  |  |  |  |  |  |
| 1275/1276 | V56I; | + | +++++ |  | + |  |  |  |  |  |  |  |  |
| 1277/1278 | V56L; | + | +++++ |  | + |  |  |  |  |  |  |  |  |
| 971/972 | I177T; | + | +++++ |  | + |  |  |  |  |  |  |  |  |
| 1281/1282 | W154F; | + | +++++ |  | + |  |  |  |  |  |  |  |  |
| 973/974 | W154F;L754P; | + | +++++ |  | + |  |  |  |  |  |  |  |  |
| 975/976 | F71C;G74D; | + | ++++ | + | + |  |  |  | + |  |  |  |  |
| 1285/1286 | F71Q;G74D;P164S; | + | ++++ | + | + |  | + |  | + |  |  |  |  |
| 1287/1288 | F71G;G74D; | ++ | +++ | + | + | + | + |  |  | + | + |  |  |
| 979/980 | F701H; | + | +++++ |  | + |  |  |  |  |  |  |  |  |
| 981/982 | F701C; | + | +++++ |  | + |  |  |  |  |  |  |  |  |
| 983/984 | F701I; | ++ | +++++ |  | + |  |  |  |  |  |  |  |  |
| 985/986 | F701M; | + | +++++ |  | + |  |  |  | + |  |  |  |  |
| 1289/1290 | F701W; | + | +++++ |  | + |  |  |  |  |  |  |  |  |

FIG. 2 (Cont.)

| SEQ ID NO: (nt/aa) | Amino Acid Differences (Relative to SEQ ID NO: 1262) | A1 | | B29 | | B1 | | A1/B29 | | A1/B1 | | B1/B29 | |
|---|---|---|---|---|---|---|---|---|---|---|---|---|---|
| | | %conv.[1] | %sel.[2] | %conv.[1] | %sel.[2] | %conv.[1] | %sel.[2] | %conv.[1] | %sel.[2] | %conv.[1] | %sel.[2] | %conv.[1] | %sel.[2] |
| 1291/1292 | F701V; | + | +++++ | | | | | | | | | | |
| 987/988 | M697F; | + | +++++ | | + | | | | + | | | | + |
| 989/990 | M697G; | + | +++++ | | + | | | | + | | | | |
| 991/992 | V28A;Y31F; | | ++++ | | ++ | | | | | | | | |
| 993/994 | V28A;Y31L; | + | +++++ | | + | | | | | | | | |
| 995/996 | V28A;Y31V; | + | ++++ | | ++ | | | | | | | | |
| 997/998 | V28A;Y31T; | + | +++++ | | + | | | | | | | | |
| 999/1000 | V28A;Y31C; | + | +++++ | | + | | | | | | | | |
| 1001/1002 | V28A;Y31N; | | +++ | | +++ | | | | | | | | |
| 1003/1004 | V28A;Y31M; | + | +++++ | | ++ | | | | | | | | |
| 1005/1006 | V28A;Y31K; | | ++++ | | ++ | | | | | | | | |
| 1007/1008 | F24A;Y31W;V56I;F701W; | + | +++++ | | | | | | + | | | | |
| 1009/1010 | F24A;V56I;F701W; | + | +++++ | | | | | | | | | | |
| 1011/1012 | F24A;Y31C;V56I;S386P;F701I | | | | | | | | | | | | |

FIG. 2 (Cont.)

| SEQ ID NO: (nt/aa) | Amino Acid Differences (Relative to SEQ ID NO: 1262) | A1 | | B29 | | B1 | | A1/B29 | | A1/B1 | | B1/B29 | |
|---|---|---|---|---|---|---|---|---|---|---|---|---|---|
| | | % conv.[1] | % sel.[2] | % conv.[1] | % sel.[2] | % conv.[1] | % sel.[2] | % conv.[1] | % sel.[2] | % conv.[1] | % sel.[2] | % conv.[1] | % sel.[2] |
| 1013/1014 | F24A;F71C;F701W; | + | +++++ | | | | | | | | | | |
| 1293/1294 | F24A;P29S;V56L;T352S;N483S; | | ++++ | | ++ | | | | | | | | |
| 1261/1262 | Y; | + | +++++ | | + | | | | | | | | |
| 1015/1016 | F24A;L225V;F701Y; | + | +++++ | | | | | | | | + | | |
| 1017/1018 | F24A;Y31W;V56T;V264A;F701W;S750G; | | +++ | | ++ | | | | | | | | |
| 1019/1020 | F24A;Y31W;F701W; | + | +++++ | | + | | | | | | | | |
| 1295/1296 | F24A;Q340R;V391G; | ++ | +++++ | | ++ | | | | | | | | |
| 1021/1022 | F24A;D484N;F701W; | ++ | +++++ | | | | | | | | | | |
| 1023/1024 | F24A;V56T;F701W; | ++ | +++++ | | | | | | | | | | |

FIG. 2 (Cont.)

| SEQ ID NO: (nt/aa) | Amino Acid Differences (Relative to SEQ ID NO: 1262) | A1 % conv.[1] | A1 % sel.[2] | B29 % conv.[1] | B29 % sel.[2] | B1 % conv.[1] | B1 % sel.[2] | A1/B29 % conv.[1] | A1/B29 % sel.[2] | A1/B1 % conv.[1] | A1/B1 % sel.[2] | B1/B29 % conv.[1] | B1/B29 % sel.[2] |
|---|---|---|---|---|---|---|---|---|---|---|---|---|---|
| | 01W; | | | | | | | | | | | | |
| 1025/1026 | F24A;Y31W; | + | +++++ | | | | | | | | | | |
| 1027/1028 | F24A;V56I;W154F;I270V;M697L; | | ++++ | | ++ | | | | | | | | |
| 1297/1298 | F24A;Y31H;V56I;F71C; | | ++++ | | ++++ | | | | | | | | |
| 1029/1030 | F24A;V56I;M697F;F701W; | + | +++++ | | + | | | | | | | | |
| 1299/1300 | F24A;V56L;W240R;F701W; | | ++++ | | ++++ | | | | | | | | |
| 1031/1032 | F24A;Y31W;V56I;F701Y; | + | +++++ | | + | | | | | | | + | |
| 1301/1302 | F24A;V56T;F71C; | | ++++ | | ++++ | | | | | | | | |
| 1303/1304 | F24A;F71L; | + | +++++ | | + | | | | | | | | |
| 1033/1034 | F24A;Y31W;V56I;M697L; | + | +++++ | | + | | | | | | | | |

FIG. 2 (Cont.)

| SEQ ID NO: (nt/aa) | Amino Acid Differences (Relative to SEQ ID NO: 1262) | A1 | | B29 | | B1 | | A1/B29 | | A1/B1 | | B1/B29 | |
|---|---|---|---|---|---|---|---|---|---|---|---|---|---|
| | | %conv.[1] | %sel.[2] | %conv.[1] | %sel.[2] | %conv.[1] | %sel.[2] | %conv.[1] | %sel.[2] | %conv.[1] | %sel.[2] | %conv.[1] | %sel.[2] |
| 1035/1036 | F24Y;V28A;F71C;F701W; | + | +++++ | | + | | | | + | | | | |
| 1037/1038 | F24Y;V28A;V56I;A308T;T379A;F701W; | + | +++++ | | + | | | | + | | | | |
| 1039/1040 | F24Y;V28A;D321N;F701H; | + | +++++ | | + | | | | | | | | |
| 1041/1042 | F24Y;V28A;N457Y;F701W; | ++ | +++++ | | | | | | | | | | |
| 1043/1044 | F24Y;V28A;V56I;F701W; | + | +++++ | | | | | | | | | | |
| 1045/1046 | F24Y;V27C;V28T;F701W;V729F; | + | +++++ | | + | | | | | | | | |
| 1305/1306 | V56L;I77T;F701W; | + | +++++ | | | | | | | | | | |
| 1047/1048 | V56T;F71G;F701W; | ++ | +++++ | | | | | | | | | | |
| 1049/1050 | M697L;F701Y; | + | +++++ | | + | | | | | | | | |

FIG. 2 (Cont.)

| SEQ ID NO: (nt/aa) | Amino Acid Differences (Relative to SEQ ID NO: 1262) | A1 % conv.[1] | A1 % sel.[2] | B29 % conv.[1] | B29 % sel.[2] | B1 % conv.[1] | B1 % sel.[2] | A1/B29 % conv.[1] | A1/B29 % sel.[2] | A1/B1 % conv.[1] | A1/B1 % sel.[2] | B1/B29 % conv.[1] | B1/B29 % sel.[2] |
|---|---|---|---|---|---|---|---|---|---|---|---|---|---|
| 1307/1308 | W26C;F701W; |  | +++ |  |  |  |  |  |  |  |  |  |  |
| 1051/1052 | V56T;W658R-F701W; | + | +++++ |  | + |  |  |  |  |  |  |  |  |
| 1053/1054 | V56T;F71G;F701I; | + | +++++ |  | + |  |  |  |  |  |  |  |  |
| 1055/1056 | A410P;M697F;F701W; | + | +++++ |  | + |  |  |  |  |  |  |  |  |
| 1057/1058 | V56L;K322R;M697L,F701V; | + | +++++ |  |  |  |  |  |  |  |  |  |  |
| 1059/1060 | V56L;F701H; | + | +++++ |  | + |  |  |  |  |  |  |  |  |
| 1061/1062 | Y31C;V56L;F701H; | + | +++++ |  |  |  |  |  | + |  |  |  |  |
| 1063/1064 | F71G;F701W; | ++ | +++++ |  |  |  |  |  |  |  |  |  |  |
| 1065/1066 | T129A;I511F;F701Y; |  | +++++ |  | + |  |  |  |  |  |  |  |  |
| 1309/1310 | D501N;F701W; | + | +++++ |  | + |  |  |  |  |  |  |  |  |
| 1067/1068 | V56T;F701W;L711Q; | + | +++++ |  | + |  |  |  |  |  |  |  |  |

FIG. 2 (Cont.)

| SEQ ID NO: (nt/aa) | Amino Acid Differences (Relative to SEQ ID NO: 1262) | A1 %conv.[1] | A1 %sel.[2] | B29 %conv.[1] | B29 %sel.[2] | B1 %conv.[1] | B1 %sel.[2] | A1/B29 %conv.[1] | A1/B29 %sel.[2] | A1/B1 %conv.[1] | A1/B1 %sel.[2] | B1/B29 %conv.[1] | B1/B29 %sel.[2] |
|---|---|---|---|---|---|---|---|---|---|---|---|---|---|
| 1069/1070 | I423T;F701W; | + | +++++ |  | + |  |  |  |  |  |  |  |  |
| 1071/1072 | V56I;W154F;F701W; | + | +++++ |  | + |  |  |  |  |  |  |  |  |
| 1073/1074 | V56L;W119R;K146E;F701Y; |  | ++++ |  |  |  |  |  |  |  |  |  |  |
| 1075/1076 | V56T;M697L;F701W; | + | +++++ |  | + |  |  |  |  |  |  |  |  |
| 1311/1312 | V56T;F701W; | + | +++++ |  |  |  |  |  |  |  |  |  |  |

[1] Percent conversion was defined as follows: "+" = greater than 1% but less than 10% conversion; "++" = greater than 10.0 % but less than 20% conversion; "+++" = greater than 20% conversion.
[2] Percent selectivity was defined as follows: "+" = greater than 5% but less than 20% selective; "++" = greater than 20% but less than 40% selective; "+++" = greater than 40% but less than 60% selective; "++++" = greater than 60% but less than 80% selective; "+++++" = greater than 80%.

PENICILLIN-G ACYLASES

The present application claims priority to U.S. Prov. Pat. Appln. Ser. No. 62/332,103, filed May 5, 2016, hereby incorporated by reference in its entirety for all purposes.

FIELD OF THE INVENTION

The present invention provides engineered penicillin G acylase (PGA) enzymes, polynucleotides encoding the enzymes, compositions comprising the enzymes, and methods of using the engineered PGA enzymes.

REFERENCE TO SEQUENCE LISTING, TABLE OR COMPUTER PROGRAM

The official copy of the Sequence Listing is submitted concurrently with the specification as an ASCII formatted text file via EFS-Web, with a file name of "CX2-154US1_ST25.txt", a creation date of May 5, 2017, and a size of 8962 kilobytes. The Sequence Listing filed via EFS-Web is part of the specification and is incorporated in its entirety by reference herein.

BACKGROUND OF THE INVENTION

Penicillin G acylase (PGA) (penicillin amidase, EC 3.5.1.11) catalyzes the cleavage of the amide bond of penicillin G (benzylpenicillin) side chain. The enzyme is used commercially in the manufacture of 6-amino-penicillanic acid (6-APA) and phenyl-acetic acid (PAA). 6-APA is a key compound in the industrial production of semi-synthetic β-lactam antibiotics such as amoxicillin, ampicillin and cephalexin. The naturally occurring PGA enzyme shows instability in commercial processes, requiring immobilization on solid substrates for commercial applications. PGA has been covalently bonded to various supports and PGA immobilized systems have been reported as useful tools for the synthesis of pure optical isomers. Attachment to solid surfaces, however, leads to compromised enzyme properties, such as reduced activity and/or selectivity, and limitations to solute access. Moreover, although attachment to solid substrates allows capture of enzymes and reuse in additional processing cycles, the stability of the enzyme is such that such applications may be limited. The enzymatic catalysis by PGA of penicillin G to 6-APA is regiospecific (it does not cleave the lactam amide bond) and stereospecific. The production of 6-APA constitutes perhaps the largest utilization of enzymatic catalysis in the production of pharmaceuticals. The enzymatic activity of PGA, associated with the phenacetyl moiety, allows the stereospecific hydrolysis of a rich variety of phenacetyl derivatives of primary amines as well as alcohols.

SUMMARY OF THE INVENTION

The present invention provides engineered penicillin G acylase (PGA) enzymes, polynucleotides encoding the enzymes, compositions comprising the enzymes, and methods of using the engineered PGA enzymes.

The present invention provides engineered penicillin G acylases capable of producing phenyl acetate mono-protected or di-protected insulin by adding the protecting group to the A1, B1 or B29 positions of free insulin or removing protecting groups from A1/B1/B29 tri-protected insulin. In some embodiments, the penicillin G acylase is at least about 85%, about 86%, about 87%, about 88%, about 89%, about 90%, about 91%, about 92%, about 93%, about 94%, about 95%, about 96%, about 97%, about 98%, about 99%, or more identical to SEQ ID NO:4, 8, 14, 300, 1036, 1194, 1262, and/or 1288. In some embodiments, the present invention provides engineered penicillin G acylases capable of removing the A1, B1, or B29 tri-phenyl acetate protecting groups from insulin to produce a di-phenyl acetate protected insulin, wherein the penicillin G acylase is at least 85%, 86%, 87%, 88%, 89%, 90%, 91%, 92%, 93%, 94%, 95%, 96%, 97%, 98%, 99%, or more identical to SEQ ID NO:4, 8, 14, 300, 1036, 1194, 1262, and/or 1288. In some embodiments, the penicillin G acylase removes the A1 tri-phenyl acetate protecting group of insulin, while in some additional embodiments, the penicillin G acylase removes the B1 tri-phenyl acetate protecting group of insulin, and in still further embodiments, the penicillin G acylase removes the B29 tri-phenyl acetate protecting group of insulin. In some embodiments, the penicillin G acylase removes the A1, B1, and B29 tri-phenyl acetate protecting group of insulin. In some additional embodiments, the engineered penicillin G acylase produces more than 90%, 91%, 92%, 93%, 94%, 95%, 96%, 97%, 98%, 99% or more phenyl acetate mono-protected or di-protected insulin, as compared to the production of phenyl acetate mono-protected or di-protected insulin by the polypeptide of SEQ ID NO:2.

In some additional embodiments, the present invention provides engineered penicillin G acylases capable of removing the A1/B1/B29 tri-phenyl acetate protecting groups from insulin to produce free insulin, wherein the penicillin G acylase comprises SEQ ID NO: 4, 8, 14, 300, 1036, 1194, 1262, and/or 1288. In some further embodiments, the penicillin G acylase comprises at least one mutation in the penicillin G variants as provided in Table 5.1, 6.1, 7.1, 8.1, 8.2, 9.1, 10.1, 12.1, 12.2, 12.3, 12.4, 12.5, 12.6, and/or 12.7. In some embodiments, the present invention provides engineered penicillin G acylase comprising a sequence that is at least 85%, 90%, 91%, 92%, 93%, 94%, 95%, 96%, 97%, 98%, 99% or more identical to at least one sequence set forth in Table 5.1, 6.1, 7.1, 8.1, 8.2, 9.1, 10.1, 12.1, 12.2, 12.3, 12.4, 12.5, 12.6, and/or 12.7. In some embodiments, the penicillin G acylase comprises the variants provided in Table 5.1, 6.1, 7.1, 8.1, 8.2, 9.1, 10.1, 12.1, 12.2, 12.3, 12.4, 12.5, 12.6, and/or 12.7.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:8 and comprises at least one substitution at one or more amino acid positions or a substitution set selected from 27, 27;28;71;74;547, 27;71; 74;484;547;584;697, 71;74, 129, 253, 254, 256, 348, 352, 372, 373, 374, 380, 380;457, 386;390, 386;390, 386, 387; 390, 451, 457, 467, 470, 474, 616, 623, 704, 706, and 708, wherein the positions are numbered with reference to SEQ ID NO:8.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:14 and comprises at least one substitution at one or more amino acid positions or a substitution set selected from 9, 9;103;119;131;233;312; 324;432;444;494, 9;103;119;131;324;432;494;646, 9;103; 119;131;233;269;304;444;494;646, 9;103;119;131;304;324; 432;444;494;646, 9;103;119;233;646, 9;103;119;494, 9;103;233;312;646, 9;103;233;432;646, 9;103;233;494, 9;103;269;304;324;494;646, 9;103;304;432;444;646, 9;119; 131;233, 9;119;131;233;304;444;646, 9;119;131;233;494; 646, 9;119;131;233;494;661, 9;119;131;312;444;646, 9;119;131;432;444;646, 9;119;233;269;273;304;312;432; 444;646, 9;119;233;494;646, 9;119;304;444;494;646, 9;131;233;269;273;312;432;444;646, 9;233;273;304;494; 646, 9;233;304;494;646, 9;233;312;432;646, 9;233;494; 646, 9;312;444;646, 9;432;444;494;646, 9;494;646, 28;374; 380, 103;119;131;233;273;304;324;432;444;494;646, 103; 119;131;233;304;312;432;494;646;661, 103;119;131;269; 312;494;646, 103;119;233, 103;119;233;273;432, 103;119; 233;304;646, 103;119;233;312;646, 103;119;494;646;661, 103;119;646, 103;131;233;304;324;444;646, 103;131;269; 273;444;646, 103;233;273;312;324;432;444;646, 103;233; 273;312;432;444;646, 103;269;273;444;646, 103;273;304; 324;444;494, 103;312;444;646, 103;444;494;646, 119;131; 444;646;661, 119;131;494, 119;131;646, 119;131;304;432; 444;646;661, 119;131;444, 119;233;304;312;324;432;444; 646, 119;233;304;646, 119;233;312, 119;233;646, 119;269; 273;312;324;494;646, 119;269;273;312;432;444;646, 119; 273;324;444;494;646, 119;312;444;646, 119;432;444;646, 129;254;348;457;704, 129;348, 129;348;467;470;704;708, 129;348;470;623;704;706, 129;348;470;623;704;706;708, 129;380;470, 129;457;470;474, 129;470, 129;623, 131;233; 273;646, 131;233;304;444, 131;233;432;646, 131;273;432; 444;494;646, 185, 233;269;304;312;324;432;444;646, 253, 253;256, 253;256;352;373;374;616, 253;256;352;374;380; 451, 253;256;374;451, 253;256;380;451;616, 253;352;374; 616, 253;352;451;616, 253;373;451, 253;374;451, 253;374; 451;623, 253;451, 253;451;457, 253;254;352;374;380, 253; 256, 253;256;352;374;451, 253;256;352;380;451;616, 253; 256;352;451, 253;256;352;374;380;451, 253;256;352;380, 253;256;373, 253;256;374;616, 253;256;380, 253;256;380; 451;546;616, 253;352;373;374;451, 253;352;373;374;451; 616, 253;352;374;616, 253;352;623, 253;373;374;451;616, 253;380, 254;255;352, 254;256;352;451, 254;256;373;374; 380;451, 254;256;374, 254;256;374;451, 254;256;451, 254; 352;380, 254;256;380;451;616, 254;352;380;451, 254;352; 451, 254;373;374;380;451, 254;373;374;451, 254;374, 254; 374;380, 254;380, 254;451, 254;616, 256;352;374, 256;352; 380;451;616, 256;374;380;451;616, 256;374;616, 273;312; 444;646, 304;312;444;646, 312;444;646, 312;646, 348, 348; 372;470;623;708, 348;704;708, 352, 352;373;374;451, 352; 373;380;451, 352;373;380;451;616, 352;373;451, 352;374, 352;374;380, 352;374;380;451;616, 352;374;451, 352;374; 616, 352;380, 352;380;451, 352;380;451;616, 352;380;451; 623, 352;380;616, 352;451, 352;451;616, 352;616, 372;457; 470;623, 373;374, 373;374;451, 373;451, 373;616, 374, 374;380, 374;380;451, 374;380;451;623, 374;451, 374;451; 616, 374;616, 374;623, 380, 380;451, 380;451;616, 380; 451;623, 380;616, 380;616;623, 380;623, 415, 443, 444, 444;494, 444;646, 451, 451;616, 451;623, 457, 457;470, 457;704;708, 470;708, 492;493, 517, 560, 616, 623, 723, and 748, wherein the positions are numbered with reference to SEQ ID NO:14.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:300, and comprises at least one substitution at one or more amino acid positions or a substitution set selected from 9;61;444, 9;168;185;517; 560;748, 9;185;415, 9;185;415;443;444;517;723;748, 9;185;415;443;444;517;560, 9;185;415;443;444;517;748, 9;185;415;444;517;723;748, 9;185;415;444;517;748, 9;185;415;444;517;560, 9;185;415;444;517;560;723;748, 9;185;415;444, 9;185;415;444;560, 9;185;415;444;723;748, 9;185;415;444;517;560;723;748, 9;185;415;517;560, 9;185;415;517;723, 9;185;415;517;748, 9;185;415;748, 9;185;443;444;517;560, 9;185;443;444;723, 9;185;443; 444;560;723, 9;185;443;444;517, 9;185;444, 9;185;444; 517;560, 9;185;444;560;723, 9;185;444;560;748, 9;185; 444;517;560, 9;185;444;517;560;723, 9;185;444;517;560; 748, 9;185;444;517;723;748, 9;185;444;517;560, 9;185;444; 723, 9;185;444;517;560;723, 9;185;517, 9;185;517;560; 723;748, 9;185;748, 9;415;443;444;517;560, 9;415;443; 444;517;748, 9;415;443;444;560;723;748, 9;415;443;444; 517;560, 9;415;443;444;517;560;723, 9;415;443;444;517; 748, 9;415;443;560, 9;415;443;560;723;748, 9;415;444, 9;415;444;517;560;748, 9;415;444;517, 9;415;444;517; 560;723;748, 9;415;444;560;723;748, 9;415;444;723;748, 9;415;444;517, 9;415;444;517;560;723;748, 9;415;444; 560;723, 9;415;444;517, 9;415;444;517;560;748, 9;415; 444;517, 9;415;444;560, 9;415;444;560, 9;415;444;517; 560;723, 9;415;444;560, 9;415;444;560;665;723;748, 9;415;444;723;748, 9;415;517, 9;415;517;560;723;748, 9;415;517;560;723;748, 9;415;517;560;748, 9;415;560, 9;415;748, 9;443;444;517;560;723, 9;443;444;560, 9;443; 444;560;723;748, 9;443;444;517, 9;443;444;560;723, 9;443;444;517, 9;443;444;517;560, 9;443;444;517;748, 9;443;517;748, 9;443;723, 9;444;517;560, 9;444;560;723, 9;444;748, 9;444;517;560;723;748, 9;444;560, 9;444;560; 723, 9;444;560;748, 9;444;560;748, 9;444;748, 9;444;517; 560;723;748, 9;444;517, 9;444;517;560;723, 9;444;517; 723, 9;444;560;748, 9;444;723, 9;444, 9;444;517;560, 9;517, 9;517;560;723, 9;517;560;748, 9;517;560;748, 9;517;723, 9;517;748, 9;560;723;748, 9;723, 103, 103;119, 103;119;129;254;256;348;494;646, 103;119;129;444;494, 103;119;254;348, 103;119;254;348;444, 103;119;254;444, 103;119;256;348;444;494;646, 103;119;256;494, 103;119; 348, 103;119;348;457, 103;119;348;457;494, 103;119;457, 103;119;494, 103;119;494;646, 103;129, 103;129;254;444; 457;494, 103;129;256;348, 103;129;348;646, 103;254, 103; 254;256;348;444;494, 103;254;646, 103;254;348, 103;254; 348;494, 103;256, 103;256;444, 103;256;457, 103;256;494, 103;348, 103;348;444, 103;348;494, 103;444, 103;494, 103; 494;646, 119;129;254;348;494, 119;129;254;457;494, 119; 129;256;348;457, 119;254;348;457, 119;256;348 119;256; 348;494, 119;256;444, 119;348, 119;348;494, 185;415;443; 444;517;560, 185;415;443;444;517, 185;415;444;517;560; 748, 185;415;444;517;748, 185;415;444;560, 185;415;560, 185;415;560;723, 185;415;723;748, 185;443;444;560, 185; 444;446;517;560, 185;444;517;560, 185;444;517;560;723; 748, 185;444;517;723, 185;444;560, 185;517;560;723, 185; 560, 185;560;723, 185;560;748, 254;457, 256;348, 256;494, 348, 348;444, 348;444;646, 348;457, 348;494, 415, 415; 443;444;517;748, 415;443;444;560, 415;443;517;560;723, 415;443;517;723, 415;444;723, 415;444;517, 415;444;517; 560;723;748, 415;444;517;560;748, 415;444;560;723, 415; 444;517;560;723, 415;444;517;723;748 415;517;560;723; 748, 415;444;560, 415;444;560;748, 415;444, 415;517, 415; 517;560, 415;517;560;748, 415;560;723, 415;723;748, 415; 723;748, 415;748, 443;444;517;560;723;748, 443;444;517; 748, 443;444, 443;444;560, 443;444;723, 443;517, 444, 444;517;560, 444;517;748, 444;748, 444;517;560;723;748, 444;560;723, 444;560, 444;560;723, 444;517, 444;517;560, 444;517;723;748, 444;560;748, 444;723, 444;517;560, 444; 560;723, 517;560, 517;560;748, 517;723, 517;748, 517;748, 560, 723, and 723;748, wherein the positions are numbered with reference to SEQ ID NO:300.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1262, and comprises at least one substitution at one or more amino acid positions or a substitution set selected from 24, 24;27;28;701;729, 24;28;56;308;379;701, 24;28;56;701, 24;28;71;701, 24;28; 321;701, 24;28;457;701, 24;31;56;386;701, 24;31, 24;31;

56;697, 24;31;56;701, 24;31;56;264;701;750, 24;31;71;701, 24;56;154;270;697, 24;56;697;701, 24;56;701, 24;71;701, 24;225;701, 24;484;701, 24;28, 28;31, 31;56;701, 56;71; 701, 56;119;146;701, 56;154;701, 56;322;697;701, 56;658; 701, 56;697;701, 56;701, 56;701;711, 697, 697;701, 71;74, 71;701, 129;511;701, 154;754, 177, 410;697;701, 423;701, 431, 697, and 701, wherein the positions are numbered with reference to SEQ ID NO:1262.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1288, and comprises at least one substitution at one or more amino acid positions or a substitution set selected from 22, 31, 31;56;264;308; 379;484;547;711;750, 32, 50, 57, 69;74, 71, 71;74, 71;74; 129, 71;74;145, 71;74;248, 71;74;470, 71;149, 75, 141, and 394, wherein the positions are numbered with reference to SEQ ID NO:1288.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1036, and comprises at least one substitution at one or more amino acid positions or a substitution set selected from 2, 47, 176, 253, 255, 384, 460, 467, 536, and 623, wherein the positions are numbered with reference to SEQ ID NO:1036.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1194, and comprises at least one substitution at one or more amino acid positions or a substitution set selected from 12;103;119;131;233;384; 444;494;S646, 12;103;119;131;233;444;494;5646, 12;103; 119;233;384;444;494;5646, 12;103;119;233;444;467;494; 5646, 12;103;119;233;444;494;536;5646, 12;103;119;233; 444;494;5646, 12;103;131;233;444;467;494;5646, 12;103; 131;233;444;494;5646, 12;103;233;444;494;5646, 12;119; 233;384;444;494;5646, 28;264;384;467;484;536;547, 103; 119;131;233;384;444;494;5646, 103;119;233;444;494; 5646, 103;233;444;494;5646, 264;384;467;484;536;547, 384;467;484;536;547, and 668, wherein the positions are numbered with reference to SEQ ID NO:1194.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1288, and comprises at least one substitution at one or more amino acid positions or a substitution set selected from 20;709, 27, 27;74;253; 254, 27;74;253;254;255;348;369;370;381, 27;74;253;254; 255;348;370;384, 27;74;253;254;255;369;370, 27;74;253; 254;255;370, 27;74;253;254;255;370;381;384, 27;74;253; 254;255;381, 27;74;253;254;348, 27;74;253;254;384, 27;74;253;255, 27;74;253;255;348;370;384, 27;74;253; 255;348;381, 27;74;253;255;348;384, 27;74;253;348;369; 370, 27;74;253;348;369;370;381, 27;74;253;348;369;370; 381;384, 27;74;253;348;370, 27;74;253;381;384, 27;74; 253;384, 27;74;254;255;348, 27;74;254;255;348;369;370; 381, 27;74;254;255;348;370, 27;74;254;255;348;381, 27;74;254;255;381, 27;74;254;348;381;384, 27;74;254; 369;370, 27;74;255;348, 27;74;255;348;369;370, 27;74; 255;348;369;381;384, 27;74;255;370, 27;74;348, 27;74; 369;370, 27;74;107;255;348;369;370, 27;74;253, 27;74; 253;254;255, 27;74;253;254;255;348;370, 27;74;253;254; 348;369;370;381, 27;74;253;254;348;369;384, 27;74;253; 254;348;370, 27;74;253;254;348;369;381, 27;74;253;254; 369, 27;74;253;254;370;381, 27;74;253;255;348;369;370, 27;74;253;255;370, 27;74;253;348, 27;74;253;348;370; 381;384, 27;74;253;369;381;384, 27;74;254, 27;74;254; 255;348;369;381, 27;74;254;255;348;370;381, 27;74;254; 255;369, 27;74;254;348, 27;74;254;348;369;381;384, 27;74;254;348;370, 27;74;254;348;370;381, 27;74;254;384, 27;74;254;348;370, 27;74;254;348;370;381, 27;74;254;384, 27;74;255;348;370, 27;74;348;384, 27;74;253;254;255; 348;369;370, 27;74;253;254;348;369, 27;74;253;254;348; 369;370, 27;74;253;254;348;370;381;384, 27;74;253;254; 348;381;384, 27;74;253;370, 27;74;254;255;348;369;370, 27;74;254;255;348;381;384, 27;74;370, 27;74;253;254; 255;348, 27;74;253;255;348;370;381, 27;74;253;255;384, 27;74;253;348;369;370;384, 27;74;253;348;381, 27;74; 254;255;348;369;384, 27;74;254;255;348;370;381;384, 27;74;254;255;370, 27;74;254;348;381, 27;74;254;369;384, 27;74;255, 27;74;255;348;369;381, 27;74;348;370, 27;74; 369;370;381;384, 27;253, 27;253;254, 27;253;254;255, 27;253;254;255;260;348;381;384, 27;253;254;255;348, 27;253;254;255;348;369;370;381;384, 27;253;254;255; 348;369;384, 27;253;254;255;348;370, 27;253;254;255; 348;370;384, 27;253;254;255;348;381;384, 27;253;254; 348, 27;253;254;348;370;381, 27;253;254;348;370;384, 27;253;254;348;381, 27;253;254;348;381;384, 27;253;254; 348;384, 27;253;254;381, 27;253;254;381;384, 27;253;254; 384, 27;253;255;348, 27;253;255;348;369;370, 27;253;255; 348;381, 27;253;255;348;384, 27;253;255;370, 27;253;255; 370;381;384, 27;253;348, 27;253;348;370;381;384, 27;253; 348;370;384, 27;253;348;381;384, 27;253;369;370, 27;253; 381;384, 27;254;255, 27;254;255;348, 27;254;255;348;369; 370, 27;254;255;348;370, 27;254;255;348;370;381, 27;254; 255;348;370;381;384, 27;254;255;348;370;384, 27;254; 255;369;370;381;384, 27;254;255;370, 27;254;255;381; 384, 27;254;255;384, 27;254;348;369;370;381;384, 27;254; 348;370, 27;254;348;381;384, 27;254;348;384, 27;254;369; 381;384, 27;254;449, 27;254;470, 27;255;348, 27;255;348; 370, 27;255;348;370;381;384, 27;255;348;381;384, 27;255; 370, 27;348, 27;348;369;370;381;384, 27;348;381, 27;348; 384, 69, 74;253;254;369;370, 74;254;255;348;384, 84, 128, 131, 132, 133, 134, 253, 253;348;370, 254, 255, 255;348; 370, 256, 317;380, 348;467, 370, 373, 377, 381, 381;672, 383, 384, 388, 453, 457, 467, 472, 615, 616, 618, 619, 620, 623, 627, 701, 705, 706, 708, and 709, wherein the positions are numbered with reference to SEQ ID NO:1288.

The present invention also provides engineered penicillin G acylase comprising a polypeptide sequence that is at least 85%, 90%, 91%, 92%, 93%, 94%, 95%, 96%, 97%, 98%, 99% or more identical to SEQ ID NO:1262, and comprises at least one substitution at one or more amino acid positions or a substitution set selected from 24;31;56;701, 24;31;56; 701, 24;31;71;701, 24;56;701, and 71;74, wherein the positions are numbered with reference to SEQ ID NO:1262.

The present invention provides engineered penicillin G acylase comprising a sequence at least 85%, 90%, 91%, 92%, 93%, 94%, 95%, 96%, 97%, 98%, 99% or more identical to at least one sequence provided in the odd-numbered sequences of SEQ ID NOS:3-1901.

The present invention further provides compositions comprising at least one penicillin G acylase provided herein. In some embodiments, the compositions comprise at least one immobilized penicillin G acylase.

The present invention also provides a penicillin G acylase encoded by a polynucleotide sequence having at least about 85%, about 86%, about 87%, about 88%, about 89%, about 90%, about 91%, about 92%, about 93%, about 94%, about 95%, about 96%, about 97%, about 98%, about 99%, or more sequence identity to a sequence selected from SEQ ID NOS:3, 7, 13, 299, 1035, 1193, 1261, and/or 1287. In some embodiments, the polynucleotide sequence encoding a penicillin G acylase has at least 85%, 86%, 87%, 88%, 89%, 90%, 91%, 92%, 93%, 94%, 95%, 96%, 97%, 98%, 99%, or more sequence identity to a sequence selected from SEQ ID NOS: 3, 7, 13, 299, 1035, 1193, 1261, and/or 1287. In some embodiments, the polynucleotide sequence is selected from SEQ ID NOS: 3, 7, 13, 299, 1035, 1193, 1261, and/or 1287. In some embodiments, the engineered polynucleotide sequence comprises a sequence at least 85%, 90%, 91%, 92%, 93%, 94%, 95%, 96%, 97%, 98%, 99% or more identical to at least one sequence provided in the odd-numbered sequences of SEQ ID NOS:3-1901.

The present invention also provides vectors comprising the polynucleotide sequences provided herein (e.g., SEQ ID NOS: 3, 7, 13, 299, 1035, 1193, 1261, and/or 1287). The present invention also provides host cells comprising the vectors provided herein (e.g., vectors comprising the polynucleotide sequences of SEQ ID NOS:3, 7, 13, 299, 1035, 1193, 1261, and/or 1287). In some embodiments, the vectors comprise at least one engineered polynucleotide sequence comprising a sequence at least 85%, 90%, 91%, 92%, 93%, 94%, 95%, 96%, 97%, 98%, 99% or more identical to at least one sequence provided in the odd-numbered sequences of SEQ ID NOS:3-1901.

The present invention also provides host cells comprising the vectors provided herein. In some embodiments, the host cell is a prokaryotic or eukaryotic cell. In some further embodiments, the host cell is a bacterial cell. In some further embodiments, the host cell is *E. coli*.

The present invention further provides compositions comprising at least one engineered penicillin G acylase provided herein. In addition, the present invention provides methods for producing the engineered penicillin G acylase provided herein, comprising culturing the host cell provided herein, under conditions such that engineered penicillin G acylase is produced. In some embodiments, the methods further comprise recovering the engineered penicillin G acylase produced.

The present invention also provides methods for producing phenyl acetate protected insulin, comprising: i) providing at least one engineered penicillin G acylase provided herein and/or a composition comprising at least one engineered penicillin G acylase provided herein, and insulin comprising A1/B1/B29 tri-phenyl acetate protecting groups or free insulin; and ii) exposing the engineered penicillin G acylase to the insulin comprising A1/B1/B29 tri-phenyl acetate protecting groups, under conditions such that the engineered penicillin G acylase removes the A1/B1/B29 tri-phenyl acetate protecting groups and free insulin, di-protected insulin or mono-protected insulin is produced; iii) exposing the engineered penicillin G acylase to insulin, under conditions such that the engineered penicillin G acylase adds the phenyl acetate protecting groups and tri-protected insulin, di-protected insulin or mono-protected insulin is produced. In some embodiments of the methods, the penicillin G acylase is at least about 85%, about 86%, about 87%, about 88%, about 89%, about 90%, about 91%, about 92%, about 93%, about 94%, about 95%, about 96%, about 97%, about 98%, about 99%, or more identical to SEQ ID NO: 4, 8, 14, 300, 1036, 1194, 1262, and/or 1288. In some embodiments of the methods, the penicillin G acylase is at least 85%, 86%, 87%, 88%, 89%, 90%, 91%, 92%, 93%, 94%, 95%, 96%, 97%, 98%, 99%, or more identical to SEQ ID NO: 4, 8, 14, 300, 1036, 1194, 1262, and/or 1288. In some further embodiments of the methods, the penicillin G acylase comprises SEQ ID NO:4, 8, 14, 300, 1036, 1194, 1262, and/or 1288. In some embodiments, the penicillin G acylase is at least 85%, 86%, 87%, 88%, 89%, 90%, 91%, 92%, 93%, 94%, 95%, 96%, 97%, 98%, 99%, or more identical to at least one even-numbered sequence provided in SEQ ID NOS:4-1902. In some embodiments, the engineered penicillin G acylase produces more than 90%, 91%, 92%, 93%, 94%, 95%, 96%, 97%, 98%, 99% or more free insulin than wild-type penicillin G acylase. The present invention also provides compositions comprising free insulin produced using the methods of the present invention. In some embodiments, the present invention provides compositions comprising phenyl acetate mono-protected or di-protected insulin produced according to any method provided herein.

The present invention also provides methods for producing phenyl acetate mono-protected or di-protected insulin, comprising: i) providing at least one engineered penicillin G acylase and/or a composition comprising at least one engineered penicillin G acylase provided herein, and free insulin; and ii) exposing engineered penicillin G acylase to insulin, under conditions such that the engineered penicillin G acylase acylates the A1, B1, and/or B29 position, thereby producing mono-protected or di-protected insulin. In some embodiments, the pencillin G acylase acylates the A1 position of insulin, while in some other embodiments, the pencillin G acylase acylates the B1 position of insulin, and in still further embodiments, the penicillin G acylase acylates the B29 position of insulin. In some embodiments, the penicillin G acylase acylates the A1, B1, and B29 position of insulin. In some additional embodiments, the engineered penicillin G acylase produces more than 90%, 91%, 92%, 93%, 94%, 95%, 96%, 97%, 98%, 99% or more phenyl acetate mono-protected or di-protected insulin, as compared to the production of phenyl acetate mono-protected or di-protected insulin by the polypeptide of SEQ ID NO:2. In some further embodiments, the penicillin G acylase used to acylate A1, B1 and/or B29 comprises a sequence having at least 85%, 90%, 91%, 92%, 93%, 94%, 95%, 96%, 97%, 98%, 99% or more identity to SEQ ID NO: 4, 8, 14, 300, 1036, 1194, 1262, and/or 1288. In some embodiments, the penicillin G acylase is at least 85%, 86%, 87%, 88%, 89%, 90%, 91%, 92%, 93%, 94%, 95%, 96%, 97%, 98%, 99%, or more identical to at least one even-numbered sequence provided in SEQ ID NOS:4-1902.

In some further embodiments of the methods, the penicillin G acylase comprises a sequence having at least 85%, 90%, 91%, 92%, 93%, 94%, 95%, 96%, 97%, 98%, 99% or more identity to at least one sequence in Tables 5.1, 6.1, 7.1, 8.1, 8.2, 9.1, 10.1, 12.1, 12.2, 12.3, 12.4, 12.5, 12.6, and/or 12.7. In still further embodiments of the methods, the penicillin G acylase comprises a sequence set forth in any of Tables 5.1, 6.1, 7.1, 8.1, 8.2, 9.1, 10.1, 12.1, 12.2, 12.3, 12.4, 12.5, 12.6, and/or 12.7.

The present invention also provides methods for producing phenyl acetate mono-protected or di-protected insulin, comprising: i) providing the engineered penicillin G acylase of claim 1, and insulin; and ii) exposing engineered penicillin G acylase to insulin, under conditions such that engineered penicillin G acylase adds the A1, B1 and/or B29 tri-phenyl acetate protecting groups to insulin thereby producing phenyl acetate mono-protected or di-protected insulin. In some embodiments, the penicillin G acylase adds the A1 tri-phenyl acetate protecting group of insulin, while in some additional embodiments, the penicillin G acylase adds the B1 tri-phenyl acetate protecting group of insulin, and in still additional embodiments, the penicillin G acylase adds the B29 tri-phenyl acetate protecting group of insulin. In some further embodiments, the penicillin G acylase adds the A1, B1, and B29 tri-phenyl acetate protecting group of insulin. In some embodiments, the engineered penicillin G acylase produces more than 90%, 91%, 92%, 93%, 94%, 95%, 96%, 97%, 98%, 99% or more phenyl acetate mono-protected or di-protected insulin, as compared to the production of phenyl acetate mono-protected or di-protected insulin by the polypeptide of SEQ ID NO:2. In some additional embodiments, the penicillin G acylase comprises a sequence having at least 85%, 90%, 91%, 92%, 93%, 94%, 95%, 96%, 97%, 98%, 99% or more identity to SEQ ID NO: 4, 8, 14, 300, 1036, 1194, 1262, and/or 1288. In some embodiments, the penicillin G acylase is at least 85%, 86%, 87%, 88%, 89%, 90%, 91%, 92%, 93%, 94%, 95%, 96%, 97%, 98%, 99%, or more identical to at least one even-numbered sequence provided in SEQ ID NOS:4-1902.

The present invention also provides compositions comprising phenyl acetate mono-protected or di-protected insulin produced according to any of the methods provided herein.

The present invention further provides methods in which the penicillin G acylase comprises SEQ ID NO:837, 897, 1219, or 1859.

BRIEF DESCRIPTION OF THE FIGURES

FIG. 2 provides the results of the experiments described in Example 11.

DESCRIPTION OF THE INVENTION

Figure 1:
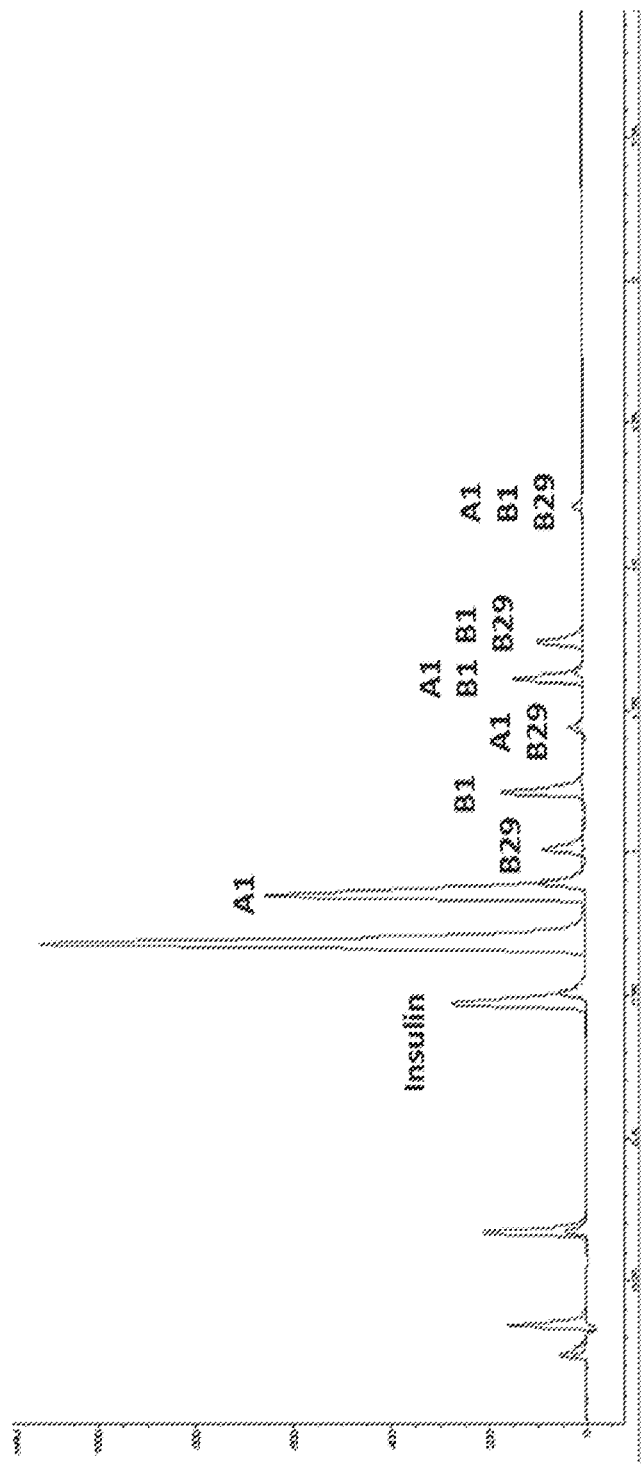
FIG. 1 provides a chromatogram of an analytical method used to quantify insulin and the elution order of the acylated products.

The present invention provides engineered penicillin G acylases (PGA) that are capable of cleaving penicillin to phenylacetic acid and 6-aminopenicillanic acid (6-APA), which is a key intermediate in the synthesis of a large variety of β-lactam antibiotics. In particular, the present invention provides engineered PGAs that are capable of producing phenyl acetate mono-protected or di-protected insulin by adding the protecting group to the A1, B1 or B29 positions of free insulin or removing protecting groups from A1/B1/B29 tri-protected insulin or removing the A1/B1/B29 tri-phenyl acetate protecting groups to release free insulin.

Generally, naturally occurring PGAs are heterodimeric enzymes composed of an alpha subunit and a beta-subunit. Wild-type PGA is naturally synthesized as a pre-pro-PGA polypeptide, containing an N-terminal signal peptide that mediates translocation to the periplasm and a linker region connecting the C-terminus of the alpha subunit to the N-terminus of the beta subunit. Proteolytic processing leads to the mature heterodimeric enzyme. The intermolecular linker region can also function in promoting proper folding of the enzyme. The PGAs provided herein are based on the PGA from *Kluyvera citrophila* in which various modifications have been introduced to generate improved enzymatic properties as described in detail below.

For the descriptions provided herein, the use of the singular includes the plural (and vice versa) unless specifically stated otherwise. For instance, the singular forms "a", "an" and "the" include plural referents unless the context clearly indicates otherwise. Similarly, "comprise," "comprises," "comprising" "include," "includes," and "including" are interchangeable and not intended to be limiting. It is to be further understood that where descriptions of various embodiments use the term "comprising," those skilled in the art would understand that in some specific instances, an embodiment can be alternatively described using language "consisting essentially of" or "consisting of."

Both the foregoing general description, including the drawings, and the following detailed description are exemplary and explanatory only and are not restrictive of this disclosure. Moreover, the section headings used herein are for organizational purposes only and not to be construed as limiting the subject matter described.

Definitions

As used herein, the following terms are intended to have the following meanings.

In reference to the present disclosure, the technical and scientific terms used in the descriptions herein will have the meanings commonly understood by one of ordinary skill in the art, unless specifically defined otherwise. Accordingly, the following terms are intended to have the following meanings. All patents and publications, including all sequences disclosed within such patents and publications, referred to herein are expressly incorporated by reference. Unless otherwise indicated, the practice of the present invention involves conventional techniques commonly used in molecular biology, fermentation, microbiology, and related fields, which are known to those of skill in the art. Unless defined otherwise herein, all technical and scientific terms used herein have the same meaning as commonly understood by one of ordinary skill in the art to which this invention belongs. Although any methods and materials similar or equivalent to those described herein can be used in the practice or testing of the present invention, the preferred methods and materials are described. Indeed, it is intended that the present invention not be limited to the particular methodology, protocols, and reagents described herein, as these may vary, depending upon the context in which they are used. The headings provided herein are not limitations of the various aspects or embodiments of the present invention.

Nonetheless, in order to facilitate understanding of the present invention, a number of terms are defined below. Numeric ranges are inclusive of the numbers defining the range. Thus, every numerical range disclosed herein is intended to encompass every narrower numerical range that falls within such broader numerical range, as if such narrower numerical ranges were all expressly written herein. It is also intended that every maximum (or minimum) numerical limitation disclosed herein includes every lower (or higher) numerical limitation, as if such lower (or higher) numerical limitations were expressly written herein.

As used herein, the term "comprising" and its cognates are used in their inclusive sense (i.e., equivalent to the term "including" and its corresponding cognates).

As used herein and in the appended claims, the singular "a", "an" and "the" include the plural reference unless the context clearly dictates otherwise. Thus, for example, reference to a "host cell" includes a plurality of such host cells.

Unless otherwise indicated, nucleic acids are written left to right in 5' to 3' orientation and amino acid sequences are written left to right in amino to carboxy orientation, respectively.

The headings provided herein are not limitations of the various aspects or embodiments of the invention that can be had by reference to the specification as a whole. Accordingly, the terms defined below are more fully defined by reference to the specification as a whole.

As used herein, the terms "protein," "polypeptide," and "peptide" are used interchangeably herein to denote a polymer of at least two amino acids covalently linked by an amide bond, regardless of length or post-translational modification (e.g., glycosylation, phosphorylation, lipidation, myristilation, ubiquitination, etc.). Included within this definition are D- and L-amino acids, and mixtures of D- and L-amino acids.

As used herein, "polynucleotide" and "nucleic acid' refer to two or more nucleosides that are covalently linked together. The polynucleotide may be wholly comprised ribonucleosides (i.e., an RNA), wholly comprised of 2' deoxyribonucleotides (i.e., a DNA) or mixtures of ribo- and 2' deoxyribonucleosides. While the nucleosides will typically be linked together via standard phosphodiester linkages, the polynucleotides may include one or more nonstandard linkages. The polynucleotide may be single-stranded or double-stranded, or may include both single-stranded regions and double-stranded regions. Moreover, while a polynucleotide will typically be composed of the naturally occurring encoding nucleobases (i.e., adenine, guanine, uracil, thymine, and cytosine), it may include one or more modified and/or synthetic nucleobases (e.g., inosine, xanthine, hypoxanthine, etc.). Preferably, such modified or synthetic nucleobases will be encoding nucleobases.

As used herein, "hybridization stringency" relates to hybridization conditions, such as washing conditions, in the hybridization of nucleic acids. Generally, hybridization reactions are performed under conditions of lower stringency, followed by washes of varying but higher stringency. The term "moderately stringent hybridization" refers to conditions that permit target-DNA to bind a complementary nucleic acid that has about 60% identity, preferably about 75% identity, about 85% identity to the target DNA; with greater than about 90% identity to target-polynucleotide. Exemplary moderately stringent conditions are conditions equivalent to hybridization in 50% formamide, 5×Denhart's solution, 5×SSPE, 0.2% SDS at 42° C., followed by washing in 0.2×SSPE, 0.2% SDS, at 42° C. "High stringency hybridization" refers generally to conditions that are about 10° C. or less from the thermal melting temperature $T_m$ as determined under the solution condition for a defined polynucleotide sequence. In some embodiments, a high stringency condition refers to conditions that permit hybridization of only those nucleic acid sequences that form stable hybrids in 0.018M NaCl at 65° C. (i.e., if a hybrid is not stable in 0.018M NaCl at 65° C., it will not be stable under high stringency conditions, as contemplated herein). High stringency conditions can be provided, for example, by hybridization in conditions equivalent to 50% formamide, 5×Denhart's solution, 5×SSPE, 0.2% SDS at 42° C., followed by washing in 0.1×SSPE, and 0.1% SDS at 65° C. Another high stringency condition is hybridizing in conditions equivalent to hybridizing in 5×SSC containing 0.1% (w:v) SDS at 65° C. and washing in 0.1×SSC containing 0.1% SDS at 65° C. Other high stringency hybridization conditions, as well as moderately stringent conditions, are known to those of skill in the art.

As used herein, "coding sequence" refers to that portion of a nucleic acid (e.g., a gene) that encodes an amino acid sequence of a protein.

As used herein, "codon optimized" refers to changes in the codons of the polynucleotide encoding a protein to those preferentially used in a particular organism such that the encoded protein is efficiently expressed in the organism of interest. In some embodiments, the polynucleotides encoding the PGA enzymes may be codon optimized for optimal production from the host organism selected for expression. Although the genetic code is degenerate in that most amino acids are represented by several codons, called "synonyms" or "synonymous" codons, it is well known that codon usage by particular organisms is nonrandom and biased towards particular codon triplets. This codon usage bias may be higher in reference to a given gene, genes of common function or ancestral origin, highly expressed proteins versus low copy number proteins, and the aggregate protein coding regions of an organism's genome. In some embodiments, the polynucleotides encoding the PGAs enzymes may be codon optimized for optimal production from the host organism selected for expression.

As used herein, "preferred, optimal, high codon usage bias codons" refers interchangeably to codons that are used at higher frequency in the protein coding regions than other codons that code for the same amino acid. The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. Codons whose frequency increases with the level of gene expression are typically optimal codons for expression. A variety of methods are known for determining the codon frequency (e.g., codon usage, relative synonymous codon usage) and codon preference in specific organisms, including multivariate analysis, for example, using cluster analysis or correspondence analysis, and the effective number of codons used in a gene (See e.g., GCG CodonPreference, Genetics Computer Group Wisconsin Package; CodonW, John Peden, University of Nottingham; McInerney, Bioinform., 14:372-73 [1998]; Stenico et al., Nucleic Acids Res., 222:437-46 [1994]; and Wright, Gene 87:23-29 [1990]). Codon usage tables are available for a growing list of organisms (See e.g., Wada et al., Nucleic Acids Res., 20:2111-2118 [1992]; Nakamura et al., Nucl. Acids Res., 28:292 [2000]; Duret, et al., supra; Henaut and Danchin, "*Escherichia coli* and *Salmonella*," Neidhardt, et al. (eds.), ASM Press, Washington D.C., [1996], p. 2047-2066. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTS), or predicted coding regions of genomic sequences (See e.g., Uberbacher, Meth. Enzymol., 266:259-281 [1996]; Tiwari et al., Comput. Appl. Biosci., 13:263-270 [1997]).

As used herein, "control sequence" is defined herein to include all components, which are necessary or advantageous for the expression of a polynucleotide and/or polypeptide of the present invention. Each control sequence may be native or foreign to the polynucleotide of interest. Such control sequences include, but are not limited to, a leader, polyadenylation sequence, propeptide sequence, promoter, signal peptide sequence, and transcription terminator.

As used herein, "operably linked" is defined herein as a configuration in which a control sequence is appropriately placed (i.e., in a functional relationship) at a position relative to a polynucleotide of interest such that the control sequence directs or regulates the expression of the polynucleotide and/or polypeptide of interest.

As used herein, "promoter sequence" refers to a nucleic acid sequence that is recognized by a host cell for expression of a polynucleotide of interest, such as a coding sequence. The control sequence may comprise an appropriate promoter sequence. The promoter sequence contains transcriptional control sequences, which mediate the expression of a polynucleotide of interest. The promoter may be any nucleic acid sequence which shows transcriptional activity in the host cell of choice including mutant, truncated, and hybrid promoters, and may be obtained from genes encoding extracellular or intracellular polypeptides either homologous or heterologous to the host cell.

As used herein, "naturally occurring" or "wild-type" refers to the form found in nature. For example, a naturally occurring or wild-type polypeptide or polynucleotide sequence is a sequence present in an organism that can be isolated from a source in nature and which has not been intentionally modified by human manipulation.

As used herein, "non-naturally occurring," "engineered," and "recombinant" when used in the present disclosure with reference to (e.g., a cell, nucleic acid, or polypeptide), refers to a material, or a material corresponding to the natural or native form of the material, that has been modified in a manner that would not otherwise exist in nature. In some embodiments the material is identical to naturally occurring material, but is produced or derived from synthetic materials and/or by manipulation using recombinant techniques. Non-limiting examples include, among others, recombinant cells expressing genes that are not found within the native (non-recombinant) form of the cell or express native genes that are otherwise expressed at a different level.

As used herein, "percentage of sequence identity," "percent identity," and "percent identical" refer to comparisons between polynucleotide sequences or polypeptide sequences, and are determined by comparing two optimally aligned sequences over a comparison window, wherein the portion of the polynucleotide or polypeptide sequence in the comparison window may comprise additions or deletions (i.e., gaps) as compared to the reference sequence for optimal alignment of the two sequences. The percentage is calculated by determining the number of positions at which either the identical nucleic acid base or amino acid residue occurs in both sequences or a nucleic acid base or amino acid residue is aligned with a gap to yield the number of matched positions, dividing the number of matched positions by the total number of positions in the window of comparison and multiplying the result by 100 to yield the percentage of sequence identity. Determination of optimal alignment and percent sequence identity is performed using the BLAST and BLAST 2.0 algorithms (See e.g., Altschul et al., J. Mol. Biol. 215: 403-410 [1990]; and Altschul et al., Nucl. Acids Res. 3389-3402 [1977]). Software for performing BLAST analyses is publicly available through the National Center for Biotechnology Information website.

Briefly, the BLAST analyses involve first identifying high scoring sequence pairs (HSPs) by identifying short words of length W in the query sequence, which either match or satisfy some positive-valued threshold score T when aligned with a word of the same length in a database sequence. T is referred to as, the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters M (reward score for a pair of matching residues; always >0) and N (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters W, T, and X determine the sensitivity and speed of the alignment. The BLASTN program (for nucleotide sequences) uses as defaults a wordlength (W) of 11, an expectation (E) of 10, M=5, N=−4, and a comparison of both strands. For amino acid sequences, the BLASTP program uses as defaults a wordlength (W) of 3, an expectation (E) of 10, and the BLOSUM62 scoring matrix (See e.g., Henikoff and Henikoff, Proc. Natl. Acad. Sci. USA 89:10915 [1989]).

Numerous other algorithms are available and known in the art that function similarly to BLAST in providing percent identity for two sequences. Optimal alignment of sequences for comparison can be conducted using any suitable method known in the art (e.g., by the local homology algorithm of Smith and Waterman, Adv. Appl. Math. 2:482 [1981]; by the homology alignment algorithm of Needleman and Wunsch, J. Mol. Biol. 48:443 [1970]; by the search for similarity method of Pearson and Lipman, Proc. Natl. Acad. Sci. USA 85:2444 [1988]; and/or by computerized implementations of these algorithms [GAP, BESTFIT, FASTA, and TFASTA in the GCG Wisconsin Software Package]), or by visual inspection, using methods commonly known in the art. Additionally, determination of sequence alignment and percent sequence identity can employ the BESTFIT or GAP programs in the GCG Wisconsin Software package (Accelrys, Madison Wis.), using the default parameters provided.

As used herein, "substantial identity" refers to a polynucleotide or polypeptide sequence that has at least 80 percent sequence identity, at least 85 percent identity and 89 to 95 percent sequence identity, more usually at least 99 percent sequence identity as compared to a reference sequence over a comparison window of at least 20 residue positions, frequently over a window of at least 30-50 residues, wherein the percentage of sequence identity is calculated by comparing the reference sequence to a sequence that includes deletions or additions which total 20 percent or less of the reference sequence over the window of comparison. In specific embodiments applied to polypeptides, the term "substantial identity" means that two polypeptide sequences, when optimally aligned, such as by the programs GAP or BESTFIT using default gap weights, share at least 80 percent sequence identity, preferably at least 89 percent sequence identity, at least 95 percent sequence identity or more (e.g., 99 percent sequence identity). In some preferred embodiments, residue positions that are not identical differ by conservative amino acid substitutions.

As used herein, "reference sequence" refers to a defined sequence to which another sequence is compared. A reference sequence may be a subset of a larger sequence, for example, a segment of a full-length gene or polypeptide sequence. Generally, a reference sequence is at least 20 nucleotide or amino acid residues in length, at least 25 residues in length, at least 50 residues in length, or the full length of the nucleic acid or polypeptide. Since two polynucleotides or polypeptides may each (1) comprise a sequence (i.e., a portion of the complete sequence) that is similar between the two sequences, and (2) may further comprise a sequence that is divergent between the two sequences, sequence comparisons between two (or more) polynucleotides or polypeptide are typically performed by comparing sequences of the two polynucleotides over a comparison window to identify and compare local regions of sequence similarity. The term "reference sequence" is not intended to be limited to wild-type sequences, and can include engineered or altered sequences. For example, in some embodiments, a "reference sequence" can be a previously engineered or altered amino acid sequence.

As used herein, "comparison window" refers to a conceptual segment of at least about 20 contiguous nucleotide positions or amino acids residues wherein a sequence may be compared to a reference sequence of at least 20 contiguous nucleotides or amino acids and wherein the portion of the sequence in the comparison window may comprise additions or deletions (i.e., gaps) of 20 percent or less as compared to the reference sequence (which does not comprise additions or deletions) for optimal alignment of the two sequences. The comparison window can be longer than 20 contiguous residues, and includes, optionally 30, 40, 50, 100, or longer windows.

As used herein, "corresponding to," "reference to," and "relative to" when used in the context of the numbering of a given amino acid or polynucleotide sequence refers to the numbering of the residues of a specified reference sequence when the given amino acid or polynucleotide sequence is compared to the reference sequence. In other words, the residue number or residue position of a given polymer is designated with respect to the reference sequence rather than by the actual numerical position of the residue within the given amino acid or polynucleotide sequence. For example, a given amino acid sequence, such as that of an engineered PGA, can be aligned to a reference sequence by introducing gaps to optimize residue matches between the two sequences. In these cases, although the gaps are present, the numbering of the residue in the given amino acid or polynucleotide sequence is made with respect to the reference sequence to which it has been aligned. As used herein, a reference to a residue position, such as "Xn" as further described below, is to be construed as referring to "a residue corresponding to", unless specifically denoted otherwise. Thus, for example, "X94" refers to any amino acid at position 94 in a polypeptide sequence.

As used herein, "improved enzyme property" refers to a PGA that exhibits an improvement in any enzyme property as compared to a reference PGA. For the engineered PGA polypeptides described herein, the comparison is generally made to the wild-type PGA enzyme, although in some embodiments, the reference PGA can be another improved engineered PGA. Enzyme properties for which improvement is desirable include, but are not limited to, enzymatic activity (which can be expressed in terms of percent conversion of the substrate at a specified reaction time using a specified amount of PGA), chemoselectivity, thermal stability, solvent stability, pH activity profile, cofactor requirements, refractoriness to inhibitors (e.g., product inhibition), stereospecificity, and stereoselectivity (including enantioselectivity).

As used herein, "increased enzymatic activity" refers to an improved property of the engineered PGA polypeptides, which can be represented by an increase in specific activity (e.g., product produced/time/weight protein) or an increase in percent conversion of the substrate to the product (e.g., percent conversion of starting amount of substrate to product in a specified time period using a specified amount of PGA) as compared to the reference PGA enzyme. Exemplary methods to determine enzyme activity are provided in the Examples. Any property relating to enzyme activity may be affected, including the classical enzyme properties of $K_m$, $V_{max}$ or $k_{cat}$, changes of which can lead to increased enzymatic activity. Improvements in enzyme activity can be from about 1.5 times the enzymatic activity of the corresponding wild-type PGA enzyme, to as much as 2 times, 5 times, 10 times, 20 times, 25 times, 50 times, 75 times, 100 times, or more enzymatic activity than the naturally occurring PGA or another engineered PGA from which the PGA polypeptides were derived. In specific embodiments, the engineered PGA enzyme exhibits improved enzymatic activity in the range of 1.5 to 50 times, 1.5 to 100 times greater than that of the parent PGA enzyme. It is understood by the skilled artisan that the activity of any enzyme is diffusion limited such that the catalytic turnover rate cannot exceed the diffusion rate of the substrate, including any required cofactors. The theoretical maximum of the diffusion limit, or $k_{cat}/K_m$, is generally about $10^8$ to $10^9$ ($M^{-1}$ $s^{-1}$). Hence, any improvements in the enzyme activity of the PGA will have an upper limit related to the diffusion rate of the substrates acted on by the PGA enzyme. PGA activity can be measured by any one of standard assays used for measuring the release of phenylacetic acid upon cleavage of penicillin G, such as by titration (See e.g., Simons and Gibson, Biotechnol. Tech., 13:365-367 [1999]). In some embodiments, the PGA activity can be measured by using 6-nitrophenylacetamido benzoic acid (NIPAB), which cleavage product 5-amino-2-nitro-benzoic acid is detectable spectrophotometrically (λmax=405 nm). Comparisons of enzyme activities are made using a defined preparation of enzyme, a defined assay under a set condition, and one or more defined substrates, as further described in detail herein. Generally, when lysates are compared, the numbers of cells and the amount of protein assayed are determined as well as use of identical expression systems and identical host cells to minimize variations in amount of enzyme produced by the host cells and present in the lysates.

As used herein, "increased enzymatic activity" and "increased activity" refer to an improved property of an engineered enzyme, which can be represented by an increase in specific activity (e.g., product produced/time/weight protein) or an increase in percent conversion of the substrate to the product (e.g., percent conversion of starting amount of substrate to product in a specified time period using a specified amount of PGA) as compared to a reference enzyme as described herein. Any property relating to enzyme activity may be affected, including the classical enzyme properties of $K_m$, $V_{max}$ or $k_{cat}$, changes of which can lead to increased enzymatic activity. In some embodiments, the PGA enzymes provided herein frees insulin by removing tri-phenyl acetate protecting groups from specific residues of insulin. Comparisons of enzyme activities are made using a defined preparation of enzyme, a defined assay under a set condition, and one or more defined substrates, as further described in detail herein. Generally, when enzymes in cell lysates are compared, the numbers of cells and the amount of protein assayed are determined as well as use of identical expression systems and identical host cells to minimize variations in amount of enzyme produced by the host cells and present in the lysates.

As used herein, "conversion" refers to the enzymatic transformation of a substrate to the corresponding product.

As used herein "percent conversion" refers to the percent of the substrate that is converted to the product within a period of time under specified conditions. Thus, for example, the "enzymatic activity" or "activity" of a PGA polypeptide can be expressed as "percent conversion" of the substrate to the product.

As used herein, "chemoselectivity" refers to the preferential formation in a chemical or enzymatic reaction of one product over another.

As used herein, "thermostable" and "thermal stable" are used interchangeably to refer to a polypeptide that is resistant to inactivation when exposed to a set of temperature conditions (e.g., 40-80° C.) for a period of time (e.g., 0.5-24 hrs) compared to the untreated enzyme, thus retaining a certain level of residual activity (e.g., more than 60% to 80%) after exposure to elevated temperatures.

As used herein, "solvent stable" refers to the ability of a polypeptide to maintain similar activity (e.g., more than e.g., 60% to 80%) after exposure to varying concentrations (e.g., 5-99%) of solvent (e.g., isopropyl alcohol, tetrahydrofuran, 2-methyltetrahydrofuran, acetone, toluene, butylacetate, methyl tert-butylether, etc.) for a period of time (e.g., 0.5-24 hrs) compared to the untreated enzyme.

As used herein, "pH stable" refers to a PGA polypeptide that maintains similar activity (e.g., more than 60% to 80%) after exposure to high or low pH (e.g., 4.5-6 or 8 to 12) for a period of time (e.g., 0.5-24 hrs) compared to the untreated enzyme.

As used herein, "thermo- and solvent stable" refers to a PGA polypeptide that is both thermostable and solvent stable.

As used herein, "hydrophilic amino acid or residue" refers to an amino acid or residue having a side chain exhibiting a hydrophobicity of less than zero according to the normalized consensus hydrophobicity scale of Eisenberg et al., (Eisenberg et al., J. Mol. Biol., 179:125-142 [1984]). Genetically encoded hydrophilic amino acids include L-Thr (T), L-Ser (S), L-His (H), L-Glu (E), L-Asn (N), L-Gln (Q), L-Asp (D), L-Lys (K) and L-Arg (R).

As used herein, "acidic amino acid or residue" refers to a hydrophilic amino acid or residue having a side chain exhibiting a pK value of less than about 6 when the amino acid is included in a peptide or polypeptide. Acidic amino acids typically have negatively charged side chains at physiological pH due to loss of a hydrogen ion. Genetically encoded acidic amino acids include L-Glu (E) and L-Asp (D).

As used herein, "basic amino acid or residue" refers to a hydrophilic amino acid or residue having a side chain exhibiting a pK value of greater than about 6 when the amino acid is included in a peptide or polypeptide. Basic amino acids typically have positively charged side chains at physiological pH due to association with hydronium ion. Genetically encoded basic amino acids include L-Arg (R) and L-Lys (K).

As used herein, "polar amino acid or residue" refers to a hydrophilic amino acid or residue having a side chain that is uncharged at physiological pH, but which has at least one bond in which the pair of electrons shared in common by two atoms is held more closely by one of the atoms. Genetically encoded polar amino acids include L-Asn (N), L-Gln (Q), L-Ser (S) and L-Thr (T).

As used herein, "hydrophobic amino acid or residue" refers to an amino acid or residue having a side chain exhibiting a hydrophobicity of greater than zero according to the normalized consensus hydrophobicity scale of Eisenberg et al., (Eisenberg et al., J. Mol. Biol., 179:125-142 [1984]). Genetically encoded hydrophobic amino acids include L-Pro (P), L-Ile (I), L-Phe (F), L-Val (V), L-Leu (L), L-Trp (W), L-Met (M), L-Ala (A) and L-Tyr (Y).

As used herein, "aromatic amino acid or residue" refers to a hydrophilic or hydrophobic amino acid or residue having a side chain that includes at least one aromatic or heteroaromatic ring. Genetically encoded aromatic amino acids include L-Phe (F), L-Tyr (Y) and L-Trp (W). Although owing to the pKa of its heteroaromatic nitrogen atom L-His (H) it is sometimes classified as a basic residue, or as an aromatic residue as its side chain includes a heteroaromatic ring, herein histidine is classified as a hydrophilic residue or as a "constrained residue" (see below).

As used herein, "constrained amino acid or residue" refers to an amino acid or residue that has a constrained geometry. Herein, constrained residues include L-Pro (P) and L-His (H). Histidine has a constrained geometry because it has a relatively small imidazole ring. Proline has a constrained geometry because it also has a five membered ring.

As used herein, "non-polar amino acid or residue" refers to a hydrophobic amino acid or residue having a side chain that is uncharged at physiological pH and which has bonds in which the pair of electrons shared in common by two atoms is generally held equally by each of the two atoms (i.e., the side chain is not polar). Genetically encoded non-polar amino acids include L-Gly (G), L-Leu (L), L-Val (V), L-Ile (I), L-Met (M) and L-Ala (A).

As used herein, "aliphatic amino acid or residue" refers to a hydrophobic amino acid or residue having an aliphatic hydrocarbon side chain. Genetically encoded aliphatic amino acids include L-Ala (A), L-Val (V), L-Leu (L) and L-Ile (I).

It is noted that cysteine (or "L-Cys" or "[C]") is unusual in that it can form disulfide bridges with other L-Cys (C) amino acids or other sulfanyl- or sulfhydryl-containing amino acids. The "cysteine-like residues" include cysteine and other amino acids that contain sulfhydryl moieties that are available for formation of disulfide bridges. The ability of L-Cys (C) (and other amino acids with —SH containing side chains) to exist in a peptide in either the reduced free —SH or oxidized disulfide-bridged form affects whether L-Cys (C) contributes net hydrophobic or hydrophilic character to a peptide. While L-Cys (C) exhibits a hydrophobicity of 0.29 according to the normalized consensus scale of Eisenberg (Eisenberg et al., 1984, supra), it is to be understood that for purposes of the present disclosure, L-Cys (C) is categorized into its own unique group.

As used herein, "small amino acid or residue" refers to an amino acid or residue having a side chain that is composed of a total three or fewer carbon and/or heteroatoms (excluding the α-carbon and hydrogens). The small amino acids or residues may be further categorized as aliphatic, non-polar, polar or acidic small amino acids or residues, in accordance with the above definitions. Genetically-encoded small amino acids include L-Ala (A), L-Val (V), L-Cys (C), L-Asn (N), L-Ser (S), L-Thr (T) and L-Asp (D).

As used herein, "hydroxyl-containing amino acid or residue" refers to an amino acid containing a hydroxyl (—OH) moiety. Genetically-encoded hydroxyl-containing amino acids include L-Ser (S) L-Thr (T) and L-Tyr (Y).

As used herein, "amino acid difference" and "residue difference" refer to a difference in the amino acid residue at a position of a polypeptide sequence relative to the amino acid residue at a corresponding position in a reference sequence. The positions of amino acid differences generally are referred to herein as "Xn," where n refers to the corresponding position in the reference sequence upon which the residue difference is based. For example, a "residue difference at position X40 as compared to SEQ ID NO:2" refers to a difference of the amino acid residue at the polypeptide position corresponding to position 40 of SEQ ID NO:2. Thus, if the reference polypeptide of SEQ ID NO:2 has a histidine at position 40, then a "residue difference at position X40 as compared to SEQ ID NO:2" refers to an amino acid substitution of any residue other than histidine at the position of the polypeptide corresponding to position 40 of SEQ ID NO:2. In most instances herein, the specific amino acid residue difference at a position is indicated as "XnY" where "Xn" specified the corresponding position as described above, and "Y" is the single letter identifier of the amino acid found in the engineered polypeptide (i.e., the different residue than in the reference polypeptide). In some instances, the present disclosure also provides specific amino acid differences denoted by the conventional notation "AnB", where A is the single letter identifier of the residue in the reference sequence, "n" is the number of the residue position in the reference sequence, and B is the single letter identifier of the residue substitution in the sequence of the engineered polypeptide. In some instances, a polypeptide of the present disclosure can include one or more amino acid residue differences relative to a reference sequence, which is indicated by a list of the specified positions where residue differences are present relative to the reference sequence. In some embodiments, where more than one amino acid can be used in a specific residue position of a polypeptide, the various amino acid residues that can be used are separated by a "/" (e.g., X192A/G). In some embodiments, the substitutions in a substitution set are separated by a semicolon (";") or slash ("/") (e.g., for the variant PGA having the following substitution set—Y27T;G71H;D74G;D484N;Q547K;Y584F; M697L, relative to SEQ ID NO:8). The present disclosure includes engineered polypeptide sequences comprising one or more amino acid differences that include either/or both conservative and non-conservative amino acid substitutions. The amino acid sequences of the specific recombinant carbonic anhydrase polypeptides included in the Sequence Listing of the present disclosure include an initiating methionine (M) residue (i.e., M represents residue position 1). The skilled artisan, however, understands that this initiating methionine residue can be removed by biological processing machinery, such as in a host cell or in vitro translation system, to generate a mature protein lacking the initiating methionine residue, but otherwise retaining the enzyme's properties. Consequently, the term "amino acid residue difference relative to SEQ ID NO:2 at position Xn" as used herein may refer to position "Xn" or to the corresponding position (e.g., position (X−1)n) in a reference sequence that has been processed so as to lack the starting methionine.

As used herein, the phrase "conservative amino acid substitutions" refers to the interchangeability of residues having similar side chains, and thus typically involves substitution of the amino acid in the polypeptide with amino acids within the same or similar defined class of amino acids. By way of example and not limitation, in some embodiments, an amino acid with an aliphatic side chain is substituted with another aliphatic amino acid (e.g., alanine, valine, leucine, and isoleucine); an amino acid with a hydroxyl side chain is substituted with another amino acid with a hydroxyl side chain (e.g., serine and threonine); an amino acids having aromatic side chains is substituted with another amino acid having an aromatic side chain (e.g., phenylalanine, tyrosine, tryptophan, and histidine); an amino acid with a basic side chain is substituted with another amino acid with a basis side chain (e.g., lysine and arginine); an amino acid with an acidic side chain is substituted with another amino acid with an acidic side chain (e.g., aspartic acid or glutamic acid); and/or a hydrophobic or hydrophilic amino acid is replaced with another hydrophobic or hydrophilic amino acid, respectively. Exemplary conservative substitutions are provided in Table 1.

TABLE 1

Exemplary Conservative Amino Acid Substitutions

| Residue | Potential Conservative Substitutions |
|---|---|
| A, L, V, I | Other aliphatic (A, L, V, I) |
|  | Other non-polar (A, L, V, I, G, M) |
| G, M | Other non-polar (A, L, V, I, G, M) |
| D, E | Other acidic (D, E) |
| K, R | Other basic (K, R) |
| N, Q, S, T | Other polar |
| H, Y, W, F | Other aromatic (H, Y, W, F) |
| C, P | Non-polar |

As used herein, the phrase "non-conservative substitution" refers to substitution of an amino acid in the polypeptide with an amino acid with significantly differing side chain properties. Non-conservative substitutions may use amino acids between, rather than within, the defined groups and affects (a) the structure of the peptide backbone in the area of the substitution (e.g., proline for glycine) (b) the charge or hydrophobicity, or (c) the bulk of the side chain. By way of example and not limitation, an exemplary non-conservative substitution can be an acidic amino acid substituted with a basic or aliphatic amino acid; an aromatic amino acid substituted with a small amino acid; and a hydrophilic amino acid substituted with a hydrophobic amino acid.

As used herein, "deletion" refers to modification of the polypeptide by removal of one or more amino acids from the reference polypeptide. Deletions can comprise removal of 1 or more amino acids, 2 or more amino acids, 5 or more amino acids, 10 or more amino acids, 15 or more amino acids, or 20 or more amino acids, up to 10% of the total number of amino acids, or up to 20% of the total number of amino acids making up the polypeptide while retaining enzymatic activity and/or retaining the improved properties of an engineered enzyme. Deletions can be directed to the internal portions and/or terminal portions of the polypeptide. In various embodiments, the deletion can comprise a continuous segment or can be discontinuous.

As used herein, "insertion" refers to modification of the polypeptide by addition of one or more amino acids to the reference polypeptide. In some embodiments, the improved engineered PGA enzymes comprise insertions of one or more amino acids to the naturally occurring PGA polypeptide as well as insertions of one or more amino acids to engineered PGA polypeptides. Insertions can be in the internal portions of the polypeptide, or to the carboxy or amino terminus. Insertions as used herein include fusion proteins as is known in the art. The insertion can be a contiguous segment of amino acids or separated by one or more of the amino acids in the naturally occurring polypeptide.

The term "amino acid substitution set" or "substitution set" refers to a group of amino acid substitutions in a polypeptide sequence, as compared to a reference sequence. A substitution set can have 1, 2, 3, 4, 5, 6, 7, 8, 9, 10, 11, 12, 13, 14, 15, or more amino acid substitutions. In some embodiments, a substitution set refers to the set of amino acid substitutions that is present in any of the variant PGAs listed in the Tables provided in the Examples.

As used herein, "fragment" refers to a polypeptide that has an amino-terminal and/or carboxy-terminal deletion, but where the remaining amino acid sequence is identical to the corresponding positions in the sequence. Fragments can typically have about 80%, about 90%, about 95%, about 98%, or about 99% of the full-length PGA polypeptide, for example the polypeptide of SEQ ID NO:2. In some embodiments, the fragment is "biologically active" (i.e., it exhibits the same enzymatic activity as the full-length sequence).

As used herein, "isolated polypeptide" refers to a polypeptide that is substantially separated from other contaminants that naturally accompany it, e.g., protein, lipids, and polynucleotides. The term embraces polypeptides which have been removed or purified from their naturally-occurring environment or expression system (e.g., host cell or in vitro synthesis). The improved PGA enzymes may be present within a cell, present in the cellular medium, or prepared in various forms, such as lysates or isolated preparations. As such, in some embodiments, the engineered PGA polypeptides of the present disclosure can be an isolated polypeptide.

As used herein, "substantially pure polypeptide" refers to a composition in which the polypeptide species is the predominant species present (i.e., on a molar or weight basis it is more abundant than any other individual macromolecular species in the composition), and is generally a substantially purified composition when the object species comprises at least about 50 percent of the macromolecular species present by mole or % weight. Generally, a substantially pure engineered PGA polypeptide composition comprises about 60% or more, about 70% or more, about 80% or more, about 90% or more, about 91% or more, about 92% or more, about 93% or more, about 94% or more, about 95% or more, about 96% or more, about 97% or more, about 98% or more, or about 99% of all macromolecular species by mole or % weight present in the composition. Solvent species, small molecules (<500 Daltons), and elemental ion species are not considered macromolecular species. In some embodiments, the isolated improved PGA polypeptide is a substantially pure polypeptide composition.

As used herein, when used in reference to a nucleic acid or polypeptide, the term "heterologous" refers to a sequence that is not normally expressed and secreted by an organism (e.g., a wild-type organism). In some embodiments, the term encompasses a sequence that comprises two or more subsequences which are not found in the same relationship to each other as normally found in nature, or is recombinantly engineered so that its level of expression, or physical relationship to other nucleic acids or other molecules in a cell, or structure, is not normally found in nature. For instance, a heterologous nucleic acid is typically recombinantly produced, having two or more sequences from unrelated genes arranged in a manner not found in nature (e.g., a nucleic acid open reading frame (ORF) of the invention operatively linked to a promoter sequence inserted into an expression cassette, such as a vector). In some embodiments, "heterologous polynucleotide" refers to any polynucleotide that is introduced into a host cell by laboratory techniques, and includes polynucleotides that are removed from a host cell, subjected to laboratory manipulation, and then reintroduced into a host cell.

As used herein, "suitable reaction conditions" refer to those conditions in the biocatalytic reaction solution (e.g., ranges of enzyme loading, substrate loading, cofactor loading, temperature, pH, buffers, co-solvents, etc.) under which a PGA polypeptide of the present disclosure is capable of releasing free insulin by removing tri-phenyl acetate protecting groups. Exemplary "suitable reaction conditions" are provided in the present disclosure and illustrated by the Examples.

As used herein, "loading," such as in "compound loading," "enzyme loading," or "cofactor loading" refers to the concentration or amount of a component in a reaction mixture at the start of the reaction.

As used herein, "substrate" in the context of a biocatalyst mediated process refers to the compound or molecule acted on by the biocatalyst.

As used herein "product" in the context of a biocatalyst mediated process refers to the compound or molecule resulting from the action of the biocatalyst.

As used herein, "equilibration" as used herein refers to the process resulting in a steady state concentration of chemical species in a chemical or enzymatic reaction (e.g., interconversion of two species A and B), including interconversion of stereoisomers, as determined by the forward rate constant and the reverse rate constant of the chemical or enzymatic reaction.

As used herein "acylase" and "acyltransferases" are used interchangeably to refer to enzymes that are capable of transferring an acyl group from a donor to an acceptor to form esters or amides. The acylase mediated reverse reaction results in hydrolysis of the ester or amide.

As used herein, "penicillin G" and "benzylpenicillin" refer to the antibiotic also known as (2S,5R,6R)-3,3-dimethyl-7-oxo-6-(2-phenylacetamido)-4-thia-1-azabicyclo[3.2.0]heptane-2-carboxylic acid ($C_{16}H_{18}N_2O_4S$). It is primarily effective against Gram-positive organisms, although some Gram-negative organisms are also susceptible to it.

As used herein, "penicillin G acylase" and "PGA" are used interchangeably to refer to an enzyme having the capability of mediating cleavage of penicillin G (benzylpenicillin) to phenylacetic acid (PHA) and 6-aminopenicillanic acid (6-APA). In some embodiments, PGA activity can be based on cleavage of model substrates, for instance the cleavage of 6-nitro-3-(phenylacetamide)benzoic acid to phenylacetic acid and 5-amino-2-nitro-benzoic acid. PGAs are also capable of carrying out the reverse reaction of transferring an acyl group of an acyl donor to an acyl acceptor. PGAs as used herein include naturally occurring (wild type) PGAs as well as non-naturally occurring PGA enzymes comprising one or more engineered polypeptides generated by human manipulation. The wild-type PGA gene is a heterodimer consisting of alpha subunit (23.8 KDa) and beta subunit (62.2 KDa) linked by a spacer region of 54 amino acids. Due to the presence of the spacer region, an auto-processing step is required to form the active protein.

As used herein, "acyl donor" refers to that portion of the acylase substrate which donates the acyl group to an acyl acceptor to form esters or amides.

As used herein, "acyl acceptor" refers to that portion of the acylase substrate which accepts the acyl group of the acyl donor to form esters or amides.

As used herein, "α-chain sequence" refers to an amino acid sequence that corresponds to (e.g., has at least 85% identity to) the residues at positions 27 to 235 of SEQ ID NO: 2. As used herein, a single chain polypeptide can comprise an "α-chain sequence" and additional sequence(s).

As used herein, "β-chain sequence" refers to an amino acid sequence that corresponds to (e.g., has at least 85% identity to) residues at positions 290 to 846 of SEQ ID NO:2. As used herein, a single chain polypeptide can comprise an "β-chain sequence" and additional sequence(s).

As used herein, "derived from" when used in the context of engineered PGA enzymes, identifies the originating PGA enzyme, and/or the gene encoding such PGA enzyme, upon which the engineering was based. For example, the engineered PGA enzyme of SEQ ID NO: 60 was obtained by artificially evolving, over multiple generations the gene encoding the *K. citrophila* PGA alpha-chain and beta-chain sequences of SEQ ID NO:2. Thus, this engineered PGA enzyme is "derived from" the naturally occurring or wild-type PGA of SEQ ID NO: 2.

As used herein, "insulin" refers to the polypeptide hormone produced by the beta-cells of the pancreas in normal individuals. Insulin is necessary for regulating carbohydrate metabolism, by reducing blood glucose levels. Systematic deficiency of insulin results in diabetes. Insulin is comprised of 51 amino acids and has a molecular weight of approximately 5800 daltons. Insulin is comprised of two peptide chains (designated "A" and "B"), containing one intrasubunit and two intersubunit disulfide bonds. The A chain is composed of 21 amino acids and the B chain is composed of 30 amino acids. The two chains form a highly ordered structure, with several alpha-helical regions in both the A and B chains. Isolated chains are inactive. In solution, insulin is either a monomer, dimer, or hexamer. It is hexameric in the highly concentrated preparations used for subcutaneous injection, but becomes monomeric as it is diluted in body fluids. The definition is intended to encompass proinsulin and any purified isolated polypeptide having part or all of the primary structural conformation and at least one of the biological properties of naturally-occurring insulin. It is further intended to encompass natural and synthetically-derived insulin, including glycoforms, as well as analogs (e.g., polypeptides having deletions, insertions, and/or substitutions).

Insulin contains three nucleophilic amines that can potentially react with a phenylacetate-donor and be deprotected by PGA. These residues include a Lys on the B-chain at position 29 (B29) and two N-terminal free amines, Gly on the A-chain at position 1 (A1) and Phe on the B-chain at position 1 (B1). Tri-protected insulin (phenyl acetate chemically attached to A1, B1, B29 residues on human insulin) is provided herein. PGA has previously been reported to catalyze hydrolysis of N-phenylacetate-protected peptides and insulin with exclusive selectivity for the phenylacetate amide bond, leaving the rest of the peptide bonds of the protein intact (Brtnik et al., Coll. Czech. Chem. Commun., 46 (8), 1983-1989 [1981]; and Wang et al. Biopolym., 25 (Suppl.), S109-S114 [1986]).

As used herein, "tri-phenyl acetate protecting group," refers to an insulin molecule that has the three primary amines at the B1, B29 and A1 positions that are protected with a phenyl acyl group.

As used herein, "di-phenyl acetate protecting group" refers to an insulin molecule that has the two primary amines at the B1, B29 and/or the A1 positions that are protected with a phenyl acyl group.

As used herein, "di-phenyl acetate protecting group" refers to an insulin molecule that has one primary amine at the B1, B29 or the A1 positions that are protected with a phenyl acyl group.

Penicillin G Acylases

Penicillin acylase was first described from *Penicillium chrysogenum* Wisc. Q176 by Sakaguchi and Murao (Sakaguchi and Murao, J. Agr. Chem. Soc. Jpn., 23:411 [1950]). Penicillin G acylase is a hydrolytic enzyme that acts on the side chains of penicillin G, cephalosporin G, and related antibiotics to produce the β-lactam antibiotic intermediates 6-amino penicillanic acid and 7-amino des-acetoxy cephalosporanic acid, with phenyl acetic acid as a common by-product. These antibiotic intermediates are among the potential building blocks of semi-synthetic antibiotics, such as ampicillin, amoxicillin, cloxacillin, cephalexin, and cefatoxime.

As indicated above, penicillin G acylases (PGA) are characterized by the ability to catalyze the hydrolytic cleavage of penicillin G, with a conjugate base of structural formula (I), to 6-amino penicillanic acid, with a conjugate base of structural formula (II), and phenylacetic acid of structural formula (III), as shown in Scheme 1:

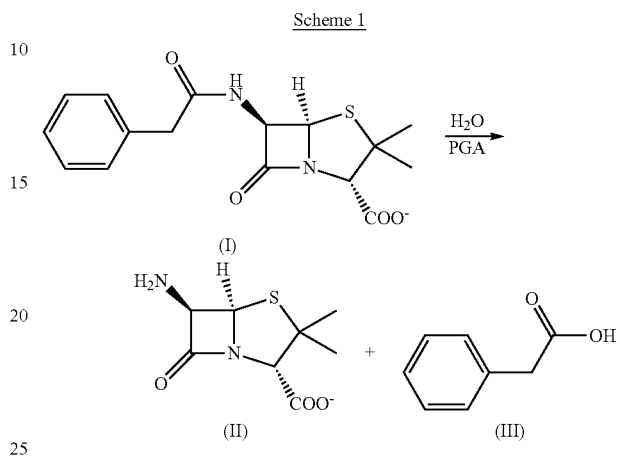

Scheme 1

While not being bound by theory, substrate specificity appears associated with recognition of the hydrophobic phenyl group while a nucleophile, which in some PGAs is a serine residue at the N-terminus of the beta-chain acts as the acceptor of beta-lactam and a variety of other groups, such as beta-amino acids. PGAs can also be characterized by the ability to cleave a model substrates analogous to penicillin G, for instance cleavage of 6-nitro-3-(phenylacetamido)benzoic acid (NIPAB) of structural formula (IV), as shown in Scheme 2:

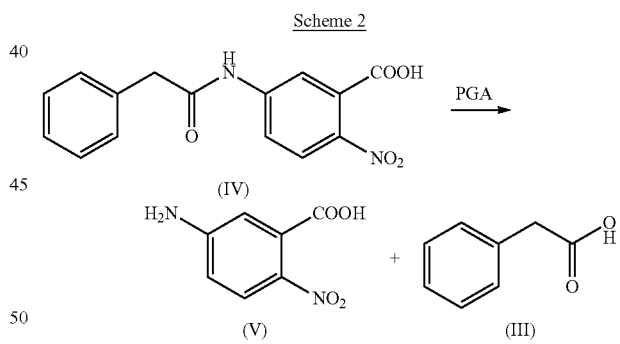

Scheme 2 to phenylacetic acid of structural formula (III) and 5-amino-2-nitro-benzoic acid of structural formula (V) (See e.g., Alkema et al., Anal. Biochem., 275:47-53 [1999]). Because the 5-amino-2-nitro-benzoic acid is chromogenic, the substrate of formula (IV) provides a convenient way of measuring PGA activity. In addition to the foregoing reactions, PGAs can also be used in the kinetic resolution of DL-tert leucine for the preparation of optically pure tert leucine (See e.g., Liu et al., Prep. Biochem. Biotechnol., 36:235-41 [2006]).

The PGAs of the present disclosure are based on the enzyme obtained from the organism *Kluyvera citrophila* (*K. citrophila*). As with PGAs from other organisms, the PGA of *K. citrophila* is a heterodimeric enzyme comprised of an alpha-subunit and a beta-subunit that is generated by proteolytic processing of a pre-pro-PGA polypeptide. Removal of a signal peptide and a spacer peptide produces the mature heterodimer (See e.g., Barbero et al., Gene 49:69-80 [1986]). The amino acid sequence of the naturally occurring pre-pro-PGA polypeptide of K. citrophila is publicly available (See e.g., Genbank accession No. P07941, [gi:129551]) and is provided herein as SEQ ID NO:2. The alpha-chain sequence of the naturally occurring K. citrophila PGA corresponds to residues 27 to 235 of SEQ ID NO:2. The beta-chain sequence of the naturally occurring K. citrophila PGA corresponds to residues 290 to 846 of SEQ ID NO:2. Residues 1 to 26 of SEQ ID NO:2 correspond to the signal peptide and residues 236-289 of SEQ ID NO:2 correspond to the linking propeptide, both of which are removed to generate the naturally occurring mature PGA enzyme which is a heterodimer comprising an α-chain subunit and a β-chain subunit.

In some embodiments, the present invention provides engineered PGA polypeptides with amino acid sequences that have at least about 85%, 86%, 87%, 88%, 89%, 90%, 91%, 92%, 93%, 94%, 95%, 96%, 97%, 98%, or 99% or more sequence identity to SEQ ID NOS:4, 8, 14, 300, 1036, 1194, 1262, and/or 1288.

The present invention provides insulin-specific deacylation biocatalysts suitable for commercial scale use. Directed evolution was used to develop efficient acylase variants capable of removing or adding the A1/B1/B29-triphenyl acetate protecting groups to insulin. The PGA variants provided herein are capable of accepting a wide range of acyl groups, exhibit increased solvent stability, and improved thermostability, as compared to the wild-type PGA. The variant PGAs provided herein lack the spacer region. Thus, the auto-processing step is not required in order to produce active enzymes.

The present invention also provides polynucleotides encoding the engineered PGA polypeptides. In some embodiments, the polynucleotides are operatively linked to one or more heterologous regulatory sequences that control gene expression, to create a recombinant polynucleotide capable of expressing the polypeptide. Expression constructs containing a heterologous polynucleotide encoding the engineered PGA polypeptides can be introduced into appropriate host cells to express the corresponding PGA polypeptide.

Because of the knowledge of the codons corresponding to the various amino acids, availability of a protein sequence provides a description of all the polynucleotides capable of encoding the subject. The degeneracy of the genetic code, where the same amino acids are encoded by alternative or synonymous codons allows an extremely large number of nucleic acids to be made, all of which encode the improved PGA enzymes disclosed herein. Thus, having identified a particular amino acid sequence, those skilled in the art could make any number of different nucleic acids by simply modifying the sequence of one or more codons in a way which does not change the amino acid sequence of the protein. In this regard, the present disclosure specifically contemplates each and every possible variation of polynucleotides that could be made by selecting combinations based on the possible codon choices, and all such variations are to be considered specifically disclosed for any polypeptide disclosed herein, including the amino acid sequences presented in the Tables in Examples 5 and 6.

In various embodiments, the codons are preferably selected to fit the host cell in which the protein is being produced. For example, preferred codons used in bacteria are used to express the gene in bacteria; preferred codons used in yeast are used for expression in yeast; and preferred codons used in mammals are used for expression in mammalian cells.

In certain embodiments, all codons need not be replaced to optimize the codon usage of the PGA polypeptides since the natural sequence will comprise preferred codons and because use of preferred codons may not be required for all amino acid residues. Consequently, codon optimized polynucleotides encoding the PGA enzymes may contain preferred codons at about 40%, 50%, 60%, 70%, 80%, or greater than 90% of codon positions of the full length coding region.

In some embodiments, the polynucleotide comprises a nucleotide sequence encoding a PGA polypeptide with an amino acid sequence that has at least about 85%, 86%, 87%, 88%, 89%, 90%, 91%, 92%, 93%, 94%, 95%, 96%, 97%, 98%, or 99% or more sequence identity to the alpha-chain and/or beta-chain any of the reference engineered PGA polypeptides described herein. Accordingly, in some embodiments, the polynucleotide encodes an amino acid sequence that is at least about 85%, 86%, 87%, 88%, 89%, 90%, 91%, 92%, 93%, 94%, 95%, 96%, 97%, 98%, 99% or more identical to a reference alpha- and beta-chain sequences based on SEQ ID NO: 4, 8, 14, 300, 1036, 1194, 1262, and/or 1288. In some embodiments, the polynucleotide encodes an alpha- and/or beta-chain amino acid sequence of SEQ ID NO: 4, 8, 14, 300, 1036, 1194, 1262, and/or 1288.

In some embodiments, the polynucleotide comprises a nucleotide sequence encoding a PGA polypeptide with an amino acid sequence that has at least about 85%, 86%, 87%, 88%, 89%, 90%, 91%, 92%, 93%, 94%, 95%, 96%, 97%, 98%, or 99% or more sequence identity to SEQ ID NO: 4, 8, 14, 300, 1036, 1194, 1262, and 1288. Accordingly, in some embodiments, the polynucleotide encodes an amino acid sequence that is at least about 85%, 86%, 87%, 88%, 89%, 90%, 91%, 92%, 93%, 94%, 95%, 96%, 97%, 98%, 99% or more identical to SEQ ID NO: 3, 7, 13, 299, 1035, 1193, 1261, and 1287.

In some embodiments, an isolated polynucleotide encoding an improved PGA polypeptide was manipulated in a variety of ways to provide for improved activity and/or expression of the polypeptide. Manipulation of the isolated polynucleotide prior to its insertion into a vector may be desirable or necessary depending on the expression vector. The techniques for modifying polynucleotides and nucleic acid sequences utilizing recombinant DNA methods are well known in the art.

For example, mutagenesis and directed evolution methods can be readily applied to polynucleotides to generate variant libraries that can be expressed, screened, and assayed. Mutagenesis and directed evolution methods are well known in the art (See e.g., U.S. Pat. Nos. 5,605,793, 5,811,238, 5,830,721, 5,834,252, 5,837,458, 5,928,905, 6,096,548, 6,117,679, 6,132,970, 6,165,793, 6,180,406, 6,251,674, 6,265,201, 6,277,638, 6,287,861, 6,287,862, 6,291,242, 6,297,053, 6,303,344, 6,309,883, 6,319,713, 6,319,714, 6,323,030, 6,326,204, 6,335,160, 6,335,198, 6,344,356, 6,352,859, 6,355,484, 6,358,740, 6,358,742, 6,365,377, 6,365,408, 6,368,861, 6,372,497, 6,337,186, 6,376,246, 6,379,964, 6,387,702, 6,391,552, 6,391,640, 6,395,547, 6,406,855, 6,406,910, 6,413,745, 6,413,774, 6,420,175, 6,423,542, 6,426,224, 6,436,675, 6,444,468, 6,455,253, 6,479,652, 6,482,647, 6,483,011, 6,484,105, 6,489,146, 6,500,617, 6,500,639, 6,506,602, 6,506,603, 6,518,065, 6,519,065, 6,521,453, 6,528,311, 6,537,746, 6,573,098, 6,576,467, 6,579,678, 6,586,182, 6,602,986, 6,605,430, 6,613,514, 6,653,072, 6,686,515, 6,703,240, 6,716,631, 6,825,001, 6,902,922, 6,917,882, 6,946,296, 6,961,664, 6,995,017, 7,024,312, 7,058,515, 7,105,297, 7,148,054, 7,220,566, 7,288,375, 7,384,387, 7,421,347, 7,430,477, 7,462,469, 7,534,564, 7,620,500, 7,620,502, 7,629,170, 7,702,464, 7,747,391, 7,747,393, 7,751,986, 7,776,598, 7,783,428, 7,795,030, 7,853,410, 7,868,138, 7,783,428, 7,873,477, 7,873,499, 7,904,249, 7,957,912, 7,981,614, 8,014,961, 8,029,988, 8,048,674, 8,058,001, 8,076,138, 8,108,150, 8,170,806, 8,224,580, 8,377,681, 8,383,346, 8,457,903, 8,504,498, 8,589,085, 8,762,066, 8,768,871, 9,593,326, and all related PCT and non-US counterparts; Ling et al., Anal. Biochem., 254(2):157-78 [1997]; Dale et al., Meth. Mol. Biol., 57:369-74 [1996]; Smith, Ann. Rev. Genet., 19:423-462 [1985]; Botstein et al., Science, 229: 1193-1201 [1985]; Carter, Biochem. J., 237:1-7 [1986]; Kramer et al., Cell, 38:879-887 [1984]; Wells et al., Gene, 34:315-323 [1985]; Minshull et al., Curr. Op. Chem. Biol., 3:284-290 [1999]; Christians et al., Nat. Biotechnol., 17:259-264 [1999]; Crameri et al., Nature, 391:288-291 [1998]; Crameri, et al., Nat. Biotechnol., 15:436-438 [1997]; Zhang et al., Proc. Nat. Acad. Sci. U.S.A., 94:4504-4509 [1997]; Crameri et al., Nat. Biotechnol., 14:315-319 [1996]; Stemmer, Nature, 370:389-391 [1994]; Stemmer, Proc. Nat. Acad. Sci. USA, 91:10747-10751 [1994]; WO 95/22625; WO 97/0078; WO 97/35966; WO 98/27230; WO 00/42651; WO 01/75767; and WO 2009/152336, all of which are incorporated herein by reference).

In some embodiments, the variant PGA acylases of the present invention further comprise additional sequences that do not alter the encoded activity of the enzyme. For example, in some embodiments, the variant PGA acylases are linked to an epitope tag or to another sequence useful in purification.

In some embodiments, the variant PGA acylase polypeptides of the present invention are secreted from the host cell in which they are expressed (e.g., a yeast or filamentous fungal host cell) and are expressed as a pre-protein including a signal peptide (i.e., an amino acid sequence linked to the amino terminus of a polypeptide and which directs the encoded polypeptide into the cell secretory pathway).

In some embodiments, the signal peptide is an endogenous *K. citrophila* PGA acylase signal peptide. In some other embodiments, signal peptides from other *K. citrophila* secreted proteins are used. In some embodiments, other signal peptides find use, depending on the host cell and other factors. Effective signal peptide coding regions for filamentous fungal host cells include, but are not limited to, the signal peptide coding regions obtained from *Aspergillus oryzae* TAKA amylase, *Aspergillus niger* neutral amylase, *Aspergillus niger* glucoamylase, *Rhizomucor miehei* aspartic proteinase, *Humicola insolens* cellulase, *Humicola lanuginosa* lipase, and *T. reesei* cellobiohydrolase II. Signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* β-lactamase, *Bacillus stearothermophilus* neutral proteases (nprT, nprS, nprM), and *Bacillus subtilis* prsA. In some additional embodiments, other signal peptides find use in the present invention (See e.g., Simonen and Palva, Microbiol. Rev., 57: 109-137 [1993], incorporated herein by reference). Additional useful signal peptides for yeast host cells include those from the genes for *Saccharomyces cerevisiae* alpha-factor, *Saccharomyces cerevisiae* SUC2 invertase (See e.g., Taussig and Carlson, Nucl. Acids Res., 11:1943-54 [1983]; SwissProt Accession No. P00724; and Romanos et al., Yeast 8:423-488 [1992]). In some embodiments, variants of these signal peptides and other signal peptides find use. Indeed, it is not intended that the present invention be limited to any specific signal peptide, as any suitable signal peptide known in the art finds use in the present invention.

In some embodiments, the present invention provides polynucleotides encoding variant PGA acylase polypeptides, and/or biologically active fragments thereof, as described herein. In some embodiments, the polynucleotide is operably linked to one or more heterologous regulatory or control sequences that control gene expression to create a recombinant polynucleotide capable of expressing the polypeptide. In some embodiments, expression constructs containing a heterologous polynucleotide encoding a variant PGA acylase is introduced into appropriate host cells to express the variant PGA acylase.

Those of ordinary skill in the art understand that due to the degeneracy of the genetic code, a multitude of nucleotide sequences encoding variant PGA acylase polypeptides of the present invention exist. For example, the codons AGA, AGG, CGA, CGC, CGG, and CGU all encode the amino acid arginine. Thus, at every position in the nucleic acids of the invention where an arginine is specified by a codon, the codon can be altered to any of the corresponding codons described above without altering the encoded polypeptide. It is understood that "U" in an RNA sequence corresponds to "T" in a DNA sequence. The invention contemplates and provides each and every possible variation of nucleic acid sequence encoding a polypeptide of the invention that could be made by selecting combinations based on possible codon choices.

As indicated above, DNA sequence encoding a PGA may also be designed for high codon usage bias codons (codons that are used at higher frequency in the protein coding regions than other codons that code for the same amino acid). The preferred codons may be determined in relation to codon usage in a single gene, a set of genes of common function or origin, highly expressed genes, the codon frequency in the aggregate protein coding regions of the whole organism, codon frequency in the aggregate protein coding regions of related organisms, or combinations thereof. A codon whose frequency increases with the level of gene expression is typically an optimal codon for expression. In particular, a DNA sequence can be optimized for expression in a particular host organism. A variety of methods are well-known in the art for determining the codon frequency (e.g., codon usage, relative synonymous codon usage) and codon preference in specific organisms, including multivariate analysis (e.g., using cluster analysis or correspondence analysis,) and the effective number of codons used in a gene. The data source for obtaining codon usage may rely on any available nucleotide sequence capable of coding for a protein. These data sets include nucleic acid sequences actually known to encode expressed proteins (e.g., complete protein coding sequences-CDS), expressed sequence tags (ESTs), or predicted coding regions of genomic sequences, as is well-known in the art. Polynucleotides encoding variant PGAs can be prepared using any suitable methods known in the art. Typically, oligonucleotides are individually synthesized, then joined (e.g., by enzymatic or chemical ligation methods, or polymerase-mediated methods) to form essentially any desired continuous sequence. In some embodiments, polynucleotides of the present invention are prepared by chemical synthesis using, any suitable methods known in the art, including but not limited to automated synthetic methods. For example, in the phosphoramidite method, oligonucleotides are synthesized (e.g., in an automatic DNA synthesizer), purified, annealed, ligated and cloned in appropriate vectors. In some embodiments, double stranded DNA fragments are then obtained either by synthesizing the complementary strand and annealing the strands together under appropriate conditions, or by adding the complementary strand using DNA polymerase with an appropriate primer sequence. There are numerous general and standard texts that provide methods useful in the present invention are well known to those skilled in the art.

The engineered PGAs can be obtained by subjecting the polynucleotide encoding the naturally occurring PGA to mutagenesis and/or directed evolution methods, as discussed above. Mutagenesis may be performed in accordance with any of the techniques known in the art, including random and site-specific mutagenesis. Directed evolution can be performed with any of the techniques known in the art to screen for improved variants including shuffling. Other directed evolution procedures that find use include, but are not limited to staggered extension process (StEP), in vitro recombination, mutagenic PCR, cassette mutagenesis, splicing by overlap extension (SOEing), ProSAR™ directed evolution methods, etc., as well as any other suitable methods.

The clones obtained following mutagenesis treatment are screened for engineered PGAs having a desired improved enzyme property. Measuring enzyme activity from the expression libraries can be performed using the standard biochemistry technique of monitoring the rate of product formation. Where an improved enzyme property desired is thermal stability, enzyme activity may be measured after subjecting the enzyme preparations to a defined temperature and measuring the amount of enzyme activity remaining after heat treatments. Clones containing a polynucleotide encoding a PGA are then isolated, sequenced to identify the nucleotide sequence changes (if any), and used to express the enzyme in a host cell.

When the sequence of the engineered polypeptide is known, the polynucleotides encoding the enzyme can be prepared by standard solid-phase methods, according to known synthetic methods. In some embodiments, fragments of up to about 100 bases can be individually synthesized, then joined (e.g., by enzymatic or chemical ligation methods, or polymerase mediated methods) to form any desired continuous sequence. For example, polynucleotides and oligonucleotides of the invention can be prepared by chemical synthesis (e.g., using the classical phosphoramidite method described by Beaucage et al., Tet. Lett., 22:1859-69 [1981], or the method described by Matthes et al., EMBO J., 3:801-05 [1984], as it is typically practiced in automated synthetic methods). According to the phosphoramidite method, oligonucleotides are synthesized (e.g., in an automatic DNA synthesizer), purified, annealed, ligated and cloned in appropriate vectors. In addition, essentially any nucleic acid can be obtained from any of a variety of commercial sources (e.g., The Midland Certified Reagent Company, Midland, Tex., The Great American Gene Company, Ramona, Calif., ExpressGen Inc. Chicago, Ill., Operon Technologies Inc., Alameda, Calif., and many others).

The present invention also provides recombinant constructs comprising a sequence encoding at least one variant PGA, as provided herein. In some embodiments, the present invention provides an expression vector comprising a variant PGA polynucleotide operably linked to a heterologous promoter. In some embodiments, expression vectors of the present invention are used to transform appropriate host cells to permit the host cells to express the variant PGA protein. Methods for recombinant expression of proteins in fungi and other organisms are well known in the art, and a number of expression vectors are available or can be constructed using routine methods. In some embodiments, nucleic acid constructs of the present invention comprise a vector, such as, a plasmid, a cosmid, a phage, a virus, a bacterial artificial chromosome (BAC), a yeast artificial chromosome (YAC), and the like, into which a nucleic acid sequence of the invention has been inserted. In some embodiments, polynucleotides of the present invention are incorporated into any one of a variety of expression vectors suitable for expressing variant PGA polypeptide(s). Suitable vectors include, but are not limited to chromosomal, non-chromosomal and synthetic DNA sequences (e.g., derivatives of SV40), as well as bacterial plasmids, phage DNA, baculovirus, yeast plasmids, vectors derived from combinations of plasmids and phage DNA, viral DNA such as vaccinia, adenovirus, fowl pox virus, pseudorabies, adenovirus, adeno-associated virus, retroviruses, and many others. Any suitable vector that transduces genetic material into a cell, and, if replication is desired, which is replicable and viable in the relevant host finds use in the present invention. In some embodiments, the construct further comprises regulatory sequences, including but not limited to a promoter, operably linked to the protein encoding sequence. Large numbers of suitable vectors and promoters are known to those of skill in the art. Indeed, in some embodiments, in order to obtain high levels of expression in a particular host it is often useful to express the variant PGAs of the present invention under the control of a heterologous promoter. In some embodiments, a promoter sequence is operably linked to the 5' region of the variant PGA coding sequence using any suitable method known in the art. Examples of useful promoters for expression of variant PGAs include, but are not limited to promoters from fungi. In some embodiments, a promoter sequence that drives expression of a gene other than a PGA gene in a fungal strain finds use. As a non-limiting example, a fungal promoter from a gene encoding an endoglucanase may be used. In some embodiments, a promoter sequence that drives the expression of a PGA gene in a fungal strain other than the fungal strain from which the PGAs were derived finds use. Examples of other suitable promoters useful for directing the transcription of the nucleotide constructs of the present invention in a filamentous fungal host cell include, but are not limited to promoters obtained from the genes for *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase, and *Fusarium oxysporum* trypsin-like protease (See e.g., WO 96/00787, incorporated herein by reference), as well as the NA2-tpi promoter (a hybrid of the promoters from the genes for *Aspergillus niger* neutral alpha-amylase and *Aspergillus oryzae* triose phosphate isomerase), promoters such as cbh1, cbh2, egl1, egl2, pepA, hfb1, hfb2, xyn1, amy, and glaA (See e.g., Nunberg et al., Mol. Cell Biol., 4:2306-2315 [1984]; Boel et al., EMBO J., 3:1581-85 [1984]; and European Patent Appln. 137280, all of which are incorporated herein by reference), and mutant, truncated, and hybrid promoters thereof.

In yeast host cells, useful promoters include, but are not limited to those from the genes for *Saccharomyces cerevisiae* enolase (eno-1), *Saccharomyces cerevisiae* galactokinase (gal1), *Saccharomyces cerevisiae* alcohol dehydrogenase/glyceraldehyde-3-phosphate dehydrogenase (ADH2/GAP), and *S. cerevisiae* 3-phosphoglycerate kinase. Additional useful promoters useful for yeast host cells are known in the art (See e.g., Romanos et al., Yeast 8:423-488 [1992], incorporated herein by reference). In addition, promoters associated with chitinase production in fungi find use in the present invention (See e.g., Blaiseau and Lafay, Gene 120243-248 [1992]; and Limon et al., Curr. Genet., 28:478-83 [1995], both of which are incorporated herein by reference).

For bacterial host cells, suitable promoters for directing transcription of the nucleic acid constructs of the present disclosure, include but are not limited to the promoters obtained from the *E. coli* lac operon, *E. coli* trp operon, bacteriophage λ, *Streptomyces coelicolor* agarase gene (dagA), *Bacillus subtilis* levansucrase gene (sacB), *Bacillus licheniformis* alpha-amylase gene (amyL), *Bacillus stearothermophilus* maltogenic amylase gene (amyM), *Bacillus amyloliquefaciens* alpha-amylase gene (amyQ), *Bacillus licheniformis* penicillinase gene (penP), *Bacillus subtilis* xylA and xylB genes, and prokaryotic beta-lactamase gene (See e.g., Villa-Kamaroff et al., Proc. Natl. Acad. Sci. USA 75: 3727-3731 [1978]), as well as the tac promoter (See e.g., DeBoer et al., Proc. Natl. Acad. Sci. USA 80: 21-25 [1983]).

In some embodiments, cloned variant PGAs of the present invention also have a suitable transcription terminator sequence, a sequence recognized by a host cell to terminate transcription. The terminator sequence is operably linked to the 3' terminus of the nucleic acid sequence encoding the polypeptide. Any terminator that is functional in the host cell of choice finds use in the present invention. Exemplary transcription terminators for filamentous fungal host cells include, but are not limited to those obtained from the genes for *Aspergillus oryzae* TAKA amylase, *Aspergillus niger* glucoamylase, *Aspergillus nidulans* anthranilate synthase, *Aspergillus niger* alpha-glucosidase, and *Fusarium oxysporum* trypsin-like protease (See also, U.S. Pat. No. 7,399,627, incorporated herein by reference). In some embodiments, exemplary terminators for yeast host cells include those obtained from the genes for *Saccharomyces cerevisiae* enolase, *Saccharomyces cerevisiae* cytochrome C (CYC1), and *Saccharomyces cerevisiae* glyceraldehyde-3-phosphate dehydrogenase. Other useful terminators for yeast host cells are well-known to those skilled in the art (See e.g., Romanos et al., Yeast 8:423-88 [1992]).

In some embodiments, a suitable leader sequence is part of a cloned variant PGA sequence, which is a nontranslated region of an mRNA that is important for translation by the host cell. The leader sequence is operably linked to the 5' terminus of the nucleic acid sequence encoding the polypeptide. Any leader sequence that is functional in the host cell of choice finds use in the present invention. Exemplary leaders for filamentous fungal host cells include, but are not limited to those obtained from the genes for *Aspergillus oryzae* TAKA amylase and *Aspergillus nidulans* triose phosphate isomerase. Suitable leaders for yeast host cells include, but are not limited to those obtained from the genes for *Saccharomyces cerevisiae* enolase (ENO-1), *Saccharomyces cerevisiae* 3-phosphoglycerate kinase, *Saccharomyces cerevisiae* alpha-factor, and *Saccharomyces cerevisiae* alcohol dehydrogenase/glyceraldehyde-3-phosphate dehydrogenase (ADH2/GAP).

In some embodiments, the sequences of the present invention also comprise a polyadenylation sequence, which is a sequence operably linked to the 3' terminus of the nucleic acid sequence and which, when transcribed, is recognized by the host cell as a signal to add polyadenosine residues to transcribed mRNA. Any polyadenylation sequence which is functional in the host cell of choice finds use in the present invention. Exemplary polyadenylation sequences for filamentous fungal host cells include, but are not limited to those obtained from the genes for *Aspergillus oryzae* TAKA amylase, *Aspergillus niger* glucoamylase, *Aspergillus nidulans* anthranilate synthase, *Fusarium oxysporum* trypsin-like protease, and *Aspergillus niger* alpha-glucosidase. Useful polyadenylation sequences for yeast host cells are known in the art (See e.g., Guo and Sherman, Mol. Cell. Biol., 15:5983-5990 [1995]).

In some embodiments, the control sequence comprises a signal peptide coding region encoding an amino acid sequence linked to the amino terminus of a polypeptide and directs the encoded polypeptide into the cell's secretory pathway. The 5' end of the coding sequence of the nucleic acid sequence may inherently contain a signal peptide coding region naturally linked in translation reading frame with the segment of the coding region that encodes the secreted polypeptide. Alternatively, the 5' end of the coding sequence may contain a signal peptide coding region that is foreign to the coding sequence. The foreign signal peptide coding region may be required where the coding sequence does not naturally contain a signal peptide coding region.

Alternatively, the foreign signal peptide coding region may simply replace the natural signal peptide coding region in order to enhance secretion of the polypeptide. However, any signal peptide coding region which directs the expressed polypeptide into the secretory pathway of a host cell of choice may be used in the present invention.

Effective signal peptide coding regions for bacterial host cells include, but are not limited to the signal peptide coding regions obtained from the genes for *Bacillus* NC1B 11837 maltogenic amylase, *Bacillus stearothermophilus* alpha-amylase, *Bacillus licheniformis* subtilisin, *Bacillus licheniformis* beta-lactamase, *Bacillus stearothermophilus* neutral proteases (nprT, nprS, nprM), and *Bacillus subtilis* prsA. Further signal peptides are known in the art (See e.g., Simonen and Palva, Microbiol. Rev., 57: 109-137 [1993]).

Effective signal peptide coding regions for filamentous fungal host cells include, but are not limited to the signal peptide coding regions obtained from the genes for *Aspergillus oryzae* TAKA amylase, *Aspergillus niger* neutral amylase, *Aspergillus niger* glucoamylase, *Rhizomucor miehei* aspartic proteinase, *Humicola insolens* cellulase, and *Humicola lanuginosa* lipase.

Useful signal peptides for yeast host cells include, but are not limited to genes for *Saccharomyces cerevisiae* alpha-factor and *Saccharomyces cerevisiae* invertase. Other useful signal peptide coding regions are known in the art (See e.g., Romanos et al., [1992], supra).

In some embodiments, the control sequence comprises a propeptide coding region that codes for an amino acid sequence positioned at the amino terminus of a polypeptide. The resultant polypeptide is known as a proenzyme or propolypeptide (or a zymogen in some cases). A propolypeptide is generally inactive and can be converted to a mature active PGA polypeptide by catalytic or autocatalytic cleavage of the propeptide from the propolypeptide. The propeptide coding region may be obtained from the genes for *Bacillus subtilis* alkaline protease (aprE), *Bacillus subtilis* neutral protease (nprT), *Saccharomyces cerevisiae* alpha-factor, *Rhizomucor miehei* aspartic proteinase, and *Myceliophthora thermophila* lactase (See e.g., WO 95/33836).

Where both signal peptide and propeptide regions are present at the amino terminus of a polypeptide, the propeptide region is positioned next to the amino terminus of a polypeptide and the signal peptide region is positioned next to the amino terminus of the propeptide region.

In some embodiments, regulatory sequences are also used to allow the regulation of the expression of the polypeptide relative to the growth of the host cell. Examples of regulatory systems are those which cause the expression of the gene to be turned on or off in response to a chemical or physical stimulus, including the presence of a regulatory compound. In prokaryotic host cells, suitable regulatory sequences include, but are not limited to the lac, tac, and trp operator systems. In yeast host cells, suitable regulatory systems include, as examples, the ADH2 system or GAL1 system. In filamentous fungi, suitable regulatory sequences include the TAKA alpha-amylase promoter, *Aspergillus niger* glucoamylase promoter, and *Aspergillus oryzae* glucoamylase promoter.

Other examples of regulatory sequences are those which allow for gene amplification. In eukaryotic systems, these include the dihydrofolate reductase gene, which is amplified in the presence of methotrexate, and the metallothionein genes, which are amplified with heavy metals. In these cases, the nucleic acid sequence encoding the PGA polypeptide of the present invention would be operably linked with the regulatory sequence.

Thus, in additional embodiments, the present invention provides recombinant expression vectors comprising a polynucleotide encoding an engineered PGA polypeptide or a variant thereof, and one or more expression regulating regions such as a promoter and a terminator, a replication origin, etc., depending on the type of hosts into which they are to be introduced. In some embodiments, the various nucleic acid and control sequences described above are joined together to produce a recombinant expression vector that may include one or more convenient restriction sites to allow for insertion or substitution of the nucleic acid sequence encoding the polypeptide at such sites. Alternatively, in some embodiments, the nucleic acid sequences are expressed by inserting the nucleic acid sequence or a nucleic acid construct comprising the sequence into an appropriate vector for expression. In creating the expression vector, the coding sequence is located in the vector so that the coding sequence is operably linked with the appropriate control sequences for expression.

The recombinant expression vector comprises any suitable vector (e.g., a plasmid or virus), that can be conveniently subjected to recombinant DNA procedures and can bring about the expression of the polynucleotide sequence. The choice of the vector typically depends on the compatibility of the vector with the host cell into which the vector is to be introduced. In some embodiments, the vectors are linear or closed circular plasmids.

In some embodiments, the expression vector is an autonomously replicating vector (i.e., a vector that exists as an extrachromosomal entity, the replication of which is independent of chromosomal replication, such as a plasmid, an extrachromosomal element, a minichromosome, or an artificial chromosome). In some embodiments, the vector contains any means for assuring self-replication. Alternatively, in some other embodiments, upon being introduced into the host cell, the vector is integrated into the genome and replicated together with the chromosome(s) into which it has been integrated. Furthermore, in additional embodiments, a single vector or plasmid or two or more vectors or plasmids which together contain the total DNA to be introduced into the genome of the host cell, or a transposon find use.

In some embodiments, the expression vector of the present invention contains one or more selectable markers, which permit easy selection of transformed cells. A "selectable marker" is a gene, the product of which provides for biocide or viral resistance, resistance to antimicrobials or heavy metals, prototrophy to auxotrophs, and the like. Any suitable selectable markers for use in a filamentous fungal host cell find use in the present invention, including, but are not limited to, amdS (acetamidase), argB (ornithine carbamoyltransferase), bar (phosphinothricin acetyltransferase), hph (hygromycin phosphotransferase), niaD (nitrate reductase), pyrG (orotidine-5'-phosphate decarboxylase), sC (sulfate adenyltransferase), and trpC (anthranilate synthase), as well as equivalents thereof. Additional markers useful in host cells such as *Aspergillus*, include but are not limited to the amdS and pyrG genes of *Aspergillus nidulans* or *Aspergillus oryzae*, and the bar gene of *Streptomyces hygroscopicus*. Suitable markers for yeast host cells include, but are not limited to ADE2, HIS3, LEU2, LYS2, MET3, TRP1, and URA3. Examples of bacterial selectable markers include, but are not limited to the dal genes from *Bacillus subtilis* or *Bacillus licheniformis*, or markers, which confer antibiotic resistance such as ampicillin, kanamycin, chloramphenicol, and or tetracycline resistance.

In some embodiments, the expression vectors of the present invention contain an element(s) that permits integration of the vector into the host cell's genome or autonomous replication of the vector in the cell independent of the genome. In some embodiments involving integration into the host cell genome, the vectors rely on the nucleic acid sequence encoding the polypeptide or any other element of the vector for integration of the vector into the genome by homologous or nonhomologous recombination.

In some alternative embodiments, the expression vectors contain additional nucleic acid sequences for directing integration by homologous recombination into the genome of the host cell. The additional nucleic acid sequences enable the vector to be integrated into the host cell genome at a precise location(s) in the chromosome(s). To increase the likelihood of integration at a precise location, the integrational elements preferably contain a sufficient number of nucleotides, such as 100 to 10,000 base pairs, preferably 400 to 10,000 base pairs, and most preferably 800 to 10,000 base pairs, which are highly homologous with the corresponding target sequence to enhance the probability of homologous recombination. The integrational elements may be any sequence that is homologous with the target sequence in the genome of the host cell. Furthermore, the integrational elements may be non-encoding or encoding nucleic acid sequences. On the other hand, the vector may be integrated into the genome of the host cell by non-homologous recombination.

For autonomous replication, the vector may further comprise an origin of replication enabling the vector to replicate autonomously in the host cell in question. Examples of bacterial origins of replication are P15A ori or the origins of replication of plasmids pBR322, pUC19, pACYC177 (which plasmid has the P15A ori), or pACYC184 permitting replication in *E. coli*, and pUB110, pE194, pTA1060, or pAMβ1 permitting replication in *Bacillus*. Examples of origins of replication for use in a yeast host cell are the 2 micron origin of replication, ARS1, ARS4, the combination of ARS1 and CEN3, and the combination of ARS4 and CEN6. The origin of replication may be one having a mutation which makes it's functioning temperature-sensitive in the host cell (See e.g., Ehrlich, Proc. Natl. Acad. Sci. USA 75:1433 [1978]).

In some embodiments, more than one copy of a nucleic acid sequence of the present invention is inserted into the host cell to increase production of the gene product. An increase in the copy number of the nucleic acid sequence can be obtained by integrating at least one additional copy of the sequence into the host cell genome or by including an amplifiable selectable marker gene with the nucleic acid sequence where cells containing amplified copies of the selectable marker gene, and thereby additional copies of the nucleic acid sequence, can be selected for by cultivating the cells in the presence of the appropriate selectable agent.

Many of the expression vectors for use in the present invention are commercially available. Suitable commercial expression vectors include, but are not limited to the p3xFLAGTM™ expression vectors (Sigma-Aldrich Chemicals), which include a CMV promoter and hGH polyadenylation site for expression in mammalian host cells and a pBR322 origin of replication and ampicillin resistance markers for amplification in *E. coli*. Other suitable expression vectors include, but are not limited to pBluescriptII SK(-) and pBK-CMV (Stratagene), and plasmids derived from pBR322 (Gibco BRL), pUC (Gibco BRL), pREP4, pCEP4 (Invitrogen) or pPoly (See e.g., Lathe et al., Gene 57:193-201 [1987]).

Thus, in some embodiments, a vector comprising a sequence encoding at least one variant PGA is transformed into a host cell in order to allow propagation of the vector and expression of the variant PGA(s). In some embodiments, the variant PGAs are post-translationally modified to remove the signal peptide and in some cases may be cleaved after secretion. In some embodiments, the transformed host cell described above is cultured in a suitable nutrient medium under conditions permitting the expression of the variant PGA(s). Any suitable medium useful for culturing the host cells finds use in the present invention, including, but not limited to minimal or complex media containing appropriate supplements. In some embodiments, host cells are grown in HTP media. Suitable media are available from various commercial suppliers or may be prepared according to published recipes (e.g., in catalogues of the American Type Culture Collection).

In another aspect, the present invention provides host cells comprising a polynucleotide encoding an improved PGA polypeptide provided herein, the polynucleotide being operatively linked to one or more control sequences for expression of the PGA enzyme in the host cell. Host cells for use in expressing the PGA polypeptides encoded by the expression vectors of the present invention are well known in the art and include but are not limited to, bacterial cells, such as *E. coli, Bacillus megaterium, Lactobacillus kefir, Streptomyces* and *Salmonella typhimurium* cells; fungal cells, such as yeast cells (e.g., *Saccharomyces cerevisiae* or *Pichia pastoris* (ATCC Accession No. 201178)); insect cells such as *Drosophila* S2 and *Spodoptera* Sf9 cells; animal cells such as CHO, COS, BHK, 293, and Bowes melanoma cells; and plant cells. Appropriate culture media and growth conditions for the above-described host cells are well known in the art.

Polynucleotides for expression of the PGA may be introduced into cells by various methods known in the art. Techniques include among others, electroporation, biolistic particle bombardment, liposome mediated transfection, calcium chloride transfection, and protoplast fusion. Various methods for introducing polynucleotides into cells are known to those skilled in the art.

In some embodiments, the host cell is a eukaryotic cell. Suitable eukaryotic host cells include, but are not limited to, fungal cells, algal cells, insect cells, and plant cells. Suitable fungal host cells include, but are not limited to, Ascomycota, Basidiomycota, Deuteromycota, Zygomycota, Fungi imperfecti. In some embodiments, the fungal host cells are yeast cells and filamentous fungal cells. The filamentous fungal host cells of the present invention include all filamentous forms of the subdivision Eumycotina and Oomycota. Filamentous fungi are characterized by a vegetative mycelium with a cell wall composed of chitin, cellulose and other complex polysaccharides. The filamentous fungal host cells of the present invention are morphologically distinct from yeast.

In some embodiments of the present invention, the filamentous fungal host cells are of any suitable genus and species, including, but not limited to *Achlya, Acremonium, Aspergillus, Aureobasidium, Bjerkandera, Ceriporiopsis, Cephalosporium, Chrysosporium, Cochliobolus, Corynascus, Cryphonectria, Cryptococcus, Coprinus, Coriolus, Diplodia, Endothis, Fusarium, Gibberella, Gliocladium, Humicola, Hypocrea, Myceliophthora, Mucor, Neurospora, Penicillium, Podospora, Phlebia, Piromyces, Pyricularia, Rhizomucor, Rhizopus, Schizophyllum, Scytalidium, Sporotrichum, Talaromyces, Thermoascus, Thielavia, Trametes, Tolypocladium, Trichoderma, Verticillium*, and/or *Volvariella*, and/or teleomorphs, or anamorphs, and synonyms, basionyms, or taxonomic equivalents thereof.

In some embodiments of the present invention, the host cell is a yeast cell, including but not limited to cells of *Candida, Hansenula, Saccharomyces, Schizosaccharomyces, Pichia, Kluyveromyces,* or *Yarrowia* species. In some embodiments of the present invention, the yeast cell is *Hansenula polymorpha, Saccharomyces cerevisiae, Saccharomyces carlsbergensis, Saccharomyces diastaticus, Saccharomyces norbensis, Saccharomyces kluyveri, Schizosaccharomyces pombe, Pichia pastoris, Pichia finlandica, Pichia trehalophila, Pichia kodamae, Pichia membranaefaciens, Pichia opuntiae, Pichia thermotolerans, Pichia salictaria, Pichia quercuum, Pichia pijperi, Pichia stipitis, Pichia methanolica, Pichia angusta, Kluyveromyces lactis, Candida albicans,* or *Yarrowia lipolytica*.

In some embodiments of the invention, the host cell is an algal cell such as *Chlamydomonas* (e.g., *C. reinhardtii*) and *Phormidium* (P. sp. ATCC29409).

In some other embodiments, the host cell is a prokaryotic cell. Suitable prokaryotic cells include, but are not limited to Gram-positive, Gram-negative and Gram-variable bacterial cells. Any suitable bacterial organism finds use in the present invention, including but not limited to *Agrobacterium, Alicyclobacillus, Anabaena, Anacystis, Acinetobacter, Acidothermus, Arthrobacter, Azobacter, Bacillus, Bifidobacterium, Brevibacterium, Butyrivibrio, Buchnera, Campestris, Camplyobacter, Clostridium, Corynebacterium, Chromatium, Coprococcus, Escherichia, Enterococcus, Enterobacter, Erwinia, Fusobacterium, Faecalibacterium, Francisella, Flavobacterium, Geobacillus, Haemophilus, Helicobacter, Klebsiella, Lactobacillus, Lactococcus, Ilyobacter, Micrococcus, Microbacterium, Mesorhizobium, Methylobacterium, Methylobacterium, Mycobacterium, Neisseria, Pantoea, Pseudomonas, Prochlorococcus, Rhodobacter, Rhodopseudomonas, Rhodopseudomonas, Roseburia, Rhodospirillum, Rhodococcus, Scenedesmus, Streptomyces, Streptococcus, Synecoccus, Saccharomonospora, Staphylococcus, Serratia, Salmonella, Shigella, Thermoanaerobacterium, Tropheryma, Tularensis, Temecula, Thermosynechococcus, Thermococcus, Ureaplasma, Xanthomonas, Xylella, Yersinia* and *Zymomonas*. In some embodiments, the host cell is a species of *Agrobacterium, Acinetobacter,*

*Azobacter, Bacillus, Bifidobacterium, Buchnera, Geobacillus, Campylobacter, Clostridium, Corynebacterium, Escherichia, Enterococcus, Erwinia, Flavobacterium, Lactobacillus, Lactococcus, Pantoea, Pseudomonas, Staphylococcus, Salmonella, Streptococcus, Streptomyces,* or *Zymomonas*. In some embodiments, the bacterial host strain is non-pathogenic to humans. In some embodiments the bacterial host strain is an industrial strain. Numerous bacterial industrial strains are known and suitable in the present invention. In some embodiments of the present invention, the bacterial host cell is an *Agrobacterium* species (e.g., *A. radiobacter, A. rhizogenes,* and *A. rubi*). In some embodiments of the present invention, the bacterial host cell is an *Arthrobacter* species (e.g., *A. aurescens, A. citreus, A. globiformis, A. hydrocarboglutamicus, A. mysorens, A. nicotianae, A. paraffineus, A. protophonniae, A. roseoparqffinus, A. sulfureus,* and *A. ureafaciens*). In some embodiments of the present invention, the bacterial host cell is a *Bacillus* species (e.g., *B. thuringensis, B. anthracis, B. megaterium, B. subtilis, B. lentus, B. circulans, B. pumilus, B. lautus, B. coagulans, B. brevis, B. firmus, B. alkaophius, B. licheniformis, B. clausii, B. stearothermophilus, B. halodurans,* and *B. amyloliquefaciens*). In some embodiments, the host cell is an industrial *Bacillus* strain including but not limited to *B. subtilis, B. pumilus, B. licheniformis, B. megaterium, B. clausii, B. stearothermophilus,* or *B. amyloliquefaciens*. In some embodiments, the *Bacillus* host cells are *B. subtilis, B. licheniformis, B. megaterium, B. stearothermophilus,* and/or *B. amyloliquefaciens*. In some embodiments, the bacterial host cell is a *Clostridium* species (e.g., *C. acetobutylicum, C. tetani* E88, *C. lituseburense, C. saccharobutylicum, C. perfringens,* and *C. beijerinckii*). In some embodiments, the bacterial host cell is a *Corynebacterium* species (e.g., *C. glutamicum* and *C. acetoacidophilum*). In some embodiments the bacterial host cell is an *Escherichia* species (e.g., *E. coli*). In some embodiments, the bacterial host cell is an *Erwinia* species (e.g., *E. uredovora, E. carotovora, E. ananas, E. herbicola, E. punctata,* and *E. terreus*). In some embodiments, the bacterial host cell is a *Pantoea* species (e.g., *P. citrea,* and *P. agglomerans*). In some embodiments the bacterial host cell is a *Pseudomonas* species (e.g., *P. putida, P. aeruginosa, P. mevalonii,* and *P.* sp. D-01 10). In some embodiments, the bacterial host cell is a *Streptococcus* species (e.g., *S. equisimiles, S. pyogenes,* and *S. uberis*). In some embodiments, the bacterial host cell is a *Streptomyces* species (e.g., *S. ambofaciens, S. achromogenes, S. avermitilis, S. coelicolor, S. aureofaciens, S. aureus, S. fungicidicus, S. griseus,* and *S. lividans*). In some embodiments, the bacterial host cell is a *Zymomonas* species (e.g., *Z. mobilis,* and *Z. lipolytica*).

An exemplary host cell is *Escherichia coli* W3110. The expression vector was created by operatively linking a polynucleotide encoding an improved PGA into the plasmid pCK110900 operatively linked to the lac promoter under control of the lad repressor. The expression vector also contained the P15a origin of replication and the chloramphenicol resistance gene. Cells containing the subject polynucleotide in *Escherichia coli* W3110 were isolated by subjecting the cells to chloramphenicol selection.

Many prokaryotic and eukaryotic strains that find use in the present invention are readily available to the public from a number of culture collections such as American Type Culture Collection (ATCC), Deutsche Sammlung von Mikroorganismen and Zellkulturen GmbH (DSM), Centraalbureau Voor Schimmelcultures (CBS), and Agricultural Research Service Patent Culture Collection, Northern Regional Research Center (NRRL).

In some embodiments, host cells are genetically modified to have characteristics that improve protein secretion, protein stability and/or other properties desirable for expression and/or secretion of a protein. Genetic modification can be achieved by genetic engineering techniques and/or classical microbiological techniques (e.g., chemical or UV mutagenesis and subsequent selection). Indeed, in some embodiments, combinations of recombinant modification and classical selection techniques are used to produce the host cells. Using recombinant technology, nucleic acid molecules can be introduced, deleted, inhibited or modified, in a manner that results in increased yields of PGA variant(s) within the host cell and/or in the culture medium. For example, knockout of Alp1 function results in a cell that is protease deficient, and knockout of pyr5 function results in a cell with a pyrimidine deficient phenotype. In one genetic engineering approach, homologous recombination is used to induce targeted gene modifications by specifically targeting a gene in vivo to suppress expression of the encoded protein. In alternative approaches, siRNA, antisense and/or ribozyme technology find use in inhibiting gene expression. A variety of methods are known in the art for reducing expression of protein in cells, including, but not limited to deletion of all or part of the gene encoding the protein and site-specific mutagenesis to disrupt expression or activity of the gene product. (See e.g., Chaveroche et al., Nucl. Acids Res., 28:22 e97 [2000]; Cho et al., Molec. Plant Microbe Interact., 19:7-15 [2006]; Maruyama and Kitamoto, Biotechnol Lett., 30:1811-1817 [2008]; Takahashi et al., Mol. Gen. Genom., 272: 344-352 [2004]; and You et al., Arch. Micriobiol., 191:615-622 [2009], all of which are incorporated by reference herein). Random mutagenesis, followed by screening for desired mutations also finds use (See e.g., Combier et al., FEMS Microbiol. Lett., 220:141-8 [2003]; and Firon et al., Eukary. Cell 2:247-55 [2003], both of which are incorporated by reference).

Introduction of a vector or DNA construct into a host cell can be accomplished using any suitable method known in the art, including but not limited to calcium phosphate transfection, DEAE-Dextran mediated transfection, PEG-mediated transformation, electroporation, or other common techniques known in the art.

In some embodiments, the engineered host cells (i.e., "recombinant host cells") of the present invention are cultured in conventional nutrient media modified as appropriate for activating promoters, selecting transformants, or amplifying the PGA polynucleotide. Culture conditions, such as temperature, pH and the like, are those previously used with the host cell selected for expression, and are well-known to those skilled in the art. As noted, many standard references and texts are available for the culture and production of many cells, including cells of bacterial, plant, animal (especially mammalian) and archebacterial origin.

In some embodiments, cells expressing the variant PGA polypeptides of the invention are grown under batch or continuous fermentations conditions. Classical "batch fermentation" is a closed system, wherein the compositions of the medium is set at the beginning of the fermentation and is not subject to artificial alternations during the fermentation. A variation of the batch system is a "fed-batch fermentation" which also finds use in the present invention. In this variation, the substrate is added in increments as the fermentation progresses. Fed-batch systems are useful when catabolite repression is likely to inhibit the metabolism of the cells and where it is desirable to have limited amounts of substrate in the medium. Batch and fed-batch fermentations are common and well known in the art. "Continuous fermentation" is an open system where a defined fermentation medium is added continuously to a bioreactor and an equal amount of conditioned medium is removed simultaneously for processing. Continuous fermentation generally maintains the cultures at a constant high density where cells are primarily in log phase growth. Continuous fermentation systems strive to maintain steady state growth conditions. Methods for modulating nutrients and growth factors for continuous fermentation processes as well as techniques for maximizing the rate of product formation are well known in the art of industrial microbiology.

In some embodiments of the present invention, cell-free transcription/translation systems find use in producing variant PGA(s). Several systems are commercially available and the methods are well-known to those skilled in the art.

The present invention provides methods of making variant PGA polypeptides or biologically active fragments thereof. In some embodiments, the method comprises: providing a host cell transformed with a polynucleotide encoding an amino acid sequence that comprises at least about 70% (or at least about 75%, at least about 80%, at least about 85%, at least about 90%, at least about 95%, at least about 96%, at least about 97%, at least about 98%, or at least about 99%) sequence identity to SEQ ID NO: 4, 8, 14, 300, 1036, 1194, 1262, and/or 1288, and comprising at least one mutation as provided herein; culturing the transformed host cell in a culture medium under conditions in which the host cell expresses the encoded variant PGA polypeptide; and optionally recovering or isolating the expressed variant PGA polypeptide, and/or recovering or isolating the culture medium containing the expressed variant PGA polypeptide. In some embodiments, the methods further provide optionally lysing the transformed host cells after expressing the encoded PGA polypeptide and optionally recovering and/or isolating the expressed variant PGA polypeptide from the cell lysate. The present invention further provides methods of making a variant PGA polypeptide comprising cultivating a host cell transformed with a variant PGA polypeptide under conditions suitable for the production of the variant PGA polypeptide and recovering the variant PGA polypeptide. Typically, recovery or isolation of the PGA polypeptide is from the host cell culture medium, the host cell or both, using protein recovery techniques that are well known in the art, including those described herein. In some embodiments, host cells are harvested by centrifugation, disrupted by physical or chemical means, and the resulting crude extract retained for further purification. Microbial cells employed in expression of proteins can be disrupted by any convenient method, including, but not limited to freeze-thaw cycling, sonication, mechanical disruption, and/or use of cell lysing agents, as well as many other suitable methods well known to those skilled in the art.

Engineered PGA enzymes expressed in a host cell can be recovered from the cells and/or the culture medium using any one or more of the well known techniques for protein purification, including, among others, lysozyme treatment, sonication, filtration, salting-out, ultra-centrifugation, and chromatography. Suitable solutions for lysing and the high efficiency extraction of proteins from bacteria, such as *E. coli*, are commercially available under the trade name Cel-Lytic B™ (Sigma-Aldrich). Thus, in some embodiments, the resulting polypeptide is recovered/isolated and optionally purified by any of a number of methods known in the art. For example, in some embodiments, the polypeptide is isolated from the nutrient medium by conventional procedures including, but not limited to, centrifugation, filtration, extraction, spray-drying, evaporation, chromatography (e.g., ion exchange, affinity, hydrophobic interaction, chromatofocusing, and size exclusion), or precipitation. In some embodiments, protein refolding steps are used, as desired, in completing the configuration of the mature protein. In addition, in some embodiments, high performance liquid chromatography (HPLC) is employed in the final purification steps. For example, in some embodiments, methods known in the art, find use in the present invention (See e.g., Parry et al., Biochem. J., 353:117 [2001]; and Hong et al., Appl. Microbiol. Biotechnol., 73:1331 [2007], both of which are incorporated herein by reference). Indeed, any suitable purification methods known in the art find use in the present invention.

Chromatographic techniques for isolation of the PGA polypeptide include, but are not limited to reverse phase chromatography high performance liquid chromatography, ion exchange chromatography, gel electrophoresis, and affinity chromatography. Conditions for purifying a particular enzyme will depend, in part, on factors such as net charge, hydrophobicity, hydrophilicity, molecular weight, molecular shape, etc., are known to those skilled in the art.

In some embodiments, affinity techniques find use in isolating the improved PGA enzymes. For affinity chromatography purification, any antibody which specifically binds the PGA polypeptide may be used. For the production of antibodies, various host animals, including but not limited to rabbits, mice, rats, etc., may be immunized by injection with the PGA. The PGA polypeptide may be attached to a suitable carrier, such as BSA, by means of a side chain functional group or linkers attached to a side chain functional group. Various adjuvants may be used to increase the immunological response, depending on the host species, including but not limited to Freund's (complete and incomplete), mineral gels such as aluminum hydroxide, surface active substances such as lysolecithin, pluronic polyols, polyanions, peptides, oil emulsions, keyhole limpet hemocyanin, dinitrophenol, and potentially useful human adjuvants such as BCG (*Bacillus* Calmette Guerin) and *Corynebacterium parvum*.

In some embodiments, the PGA variants are prepared and used in the form of cells expressing the enzymes, as crude extracts, or as isolated or purified preparations. In some embodiments, the PGA variants are prepared as lyophilisates, in powder form (e.g., acetone powders), or prepared as enzyme solutions. In some embodiments, the PGA variants are in the form of substantially pure preparations.

In some embodiments, the PGA polypeptides are attached to any suitable solid substrate. Solid substrates include but are not limited to a solid phase, surface, and/or membrane. Solid supports include, but are not limited to organic polymers such as polystyrene, polyethylene, polypropylene, polyfluoroethylene, polyethyleneoxy, and polyacrylamide, as well as co-polymers and grafts thereof. A solid support can also be inorganic, such as glass, silica, controlled pore glass (CPG), reverse phase silica or metal, such as gold or platinum. The configuration of the substrate can be in the form of beads, spheres, particles, granules, a gel, a membrane or a surface. Surfaces can be planar, substantially planar, or non-planar. Solid supports can be porous or non-porous, and can have swelling or non-swelling characteristics. A solid support can be configured in the form of a well, depression, or other container, vessel, feature, or location. A plurality of supports can be configured on an array at various locations, addressable for robotic delivery of reagents, or by detection methods and/or instruments.

In some embodiments, immunological methods are used to purify PGA variants. In one approach, antibody raised against a variant PGA polypeptide (e.g., against a polypeptide comprising any of SEQ ID NOS: 4, 8, 14, 300, 1036, 1194, 1262, and/or 1288, and/or an immunogenic fragment thereof) using conventional methods is immobilized on beads, mixed with cell culture media under conditions in which the variant PGA is bound, and precipitated. In a related approach, immunochromatography finds use.

In some embodiments, the variant PGAs are expressed as a fusion protein including a non-enzyme portion. In some embodiments, the variant PGA sequence is fused to a purification facilitating domain. As used herein, the term "purification facilitating domain" refers to a domain that mediates purification of the polypeptide to which it is fused. Suitable purification domains include, but are not limited to metal chelating peptides, histidine-tryptophan modules that allow purification on immobilized metals, a sequence which binds glutathione (e.g., GST), a hemagglutinin (HA) tag (corresponding to an epitope derived from the influenza hemagglutinin protein; See e.g., Wilson et al., Cell 37:767 [1984]), maltose binding protein sequences, the FLAG epitope utilized in the FLAGS extension/affinity purification system (e.g., the system available from Immunex Corp), and the like. One expression vector contemplated for use in the compositions and methods described herein provides for expression of a fusion protein comprising a polypeptide of the invention fused to a polyhistidine region separated by an enterokinase cleavage site. The histidine residues facilitate purification on IMIAC (immobilized metal ion affinity chromatography; See e.g., Porath et al., Prot. Exp. Purif., 3:263-281 [1992]) while the enterokinase cleavage site provides a means for separating the variant PGA polypeptide from the fusion protein. pGEX vectors (Promega) may also be used to express foreign polypeptides as fusion proteins with glutathione S-transferase (GST). In general, such fusion proteins are soluble and can easily be purified from lysed cells by adsorption to ligand-agarose beads (e.g., glutathione-agarose in the case of GST-fusions) followed by elution in the presence of free ligand.

EXPERIMENTAL

Various features and embodiments of the disclosure are illustrated in the following representative examples, which are intended to be illustrative, and not limiting.

In the experimental disclosure below, the following abbreviations apply: ppm (parts per million); M (molar); mM (millimolar), uM and μM (micromolar); nM (nanomolar); mol (moles); gm and g (gram); mg (milligrams); ug and μg (micrograms); L and l (liter); ml and mL (milliliter); cm (centimeters); mm (millimeters); um and μm (micrometers); sec. (seconds); min(s) (minute(s)); h(s) and hr(s) (hour(s)); U (units); MW (molecular weight); rpm (rotations per minute); ° C. (degrees Centigrade); RT (room temperature); CDS (coding sequence); DNA (deoxyribonucleic acid); RNA (ribonucleic acid); TB (Terrific Broth; 12 g/L bacto-tryptone, 24 g/L yeast extract, 4 mL/L glycerol, 65 mM potassium phosphate, pH 7.0, 1 mM $MgSO_4$); CAM (chloramphenicol); PMBS (polymyxin B sulfate); IPTG (isopropyl thiogalactoside); TFA (trifluoroacetic acid); HPLC (high performance liquid chromatography); FIOPC (fold improvement over positive control); HTP (high throughput); LB (Luria broth); Codexis (Codexis, Inc., Redwood City, Calif.); Sigma-Aldrich (Sigma-Aldrich, St. Louis, Mo.); Millipore (Millipore, Corp., Billerica Mass.); Difco (Difco Laboratories, BD Diagnostic Systems, Detroit, Mich.); Daicel (Daicel, West Chester, Pa.); Genetix (Genetix USA, Inc., Beaverton, Oreg.); Molecular Devices (Molecular Devices, LLC, Sunnyvale, Calif.); Applied Biosystems (Applied Biosystems, part of Life Technologies, Corp., Grand Island, N.Y.), Agilent (Agilent Technologies, Inc., Santa Clara, Calif.); Thermo Scientific (part of Thermo Fisher Scientific, Waltham, Mass.); (Infors; Infors-HT, Bottmingen/Basel, Switzerland); Corning (Corning, Inc., Palo Alto, Calif.); and Bio-Rad (Bio-Rad Laboratories, Hercules, Calif.); Microfluidics (Microfluidics Corp., Newton, Mass., United States of America).

Example 1

E. coli Expression Hosts Containing Recombinant PGA Genes

The initial PGA enzymes used to produce the variants of the present invention were obtained from either the Codex® Acylase Panel (Codexis) or variants disclosed in co-owned U.S. Prov. Pat. Appln. Ser. No. 62/158,118. The PGA panel plate comprises a collection of engineered PGA polypeptides that have improved properties, as compared to the wild-type *Kluyvera citrophila* PGA. The wild type PGA gene is a heterodimer consisting of alpha subunit (23.8 KDa) and beta subunit (62.2 KDa) linked by 54aa spacer region. Due to the presence of spacer region, an autoprocessing step is required to form the active protein. The wild-type gene was modified to eliminate the spacer region thus eliminating the auto processing step. The Codex® Acylase Panel (Codexis) contains PGA variants that lack the spacer region (See e.g., US Pat. Appln. Publn. 2010/0143968 A1). The PGA-encoding genes were cloned into the expression vector pCK110900 (See, FIG. 3 of US Pat. Appln. Publn. No. 2006/0195947) operatively linked to the lac promoter under control of the lacI repressor. The expression vector also contains the P15a origin of replication and the chloramphenicol resistance gene. The resulting plasmids were transformed into E. coli W3110, using standard methods known in the art. The transformants were isolated by subjecting the cells to chloramphenicol selection, as known in the art (See e.g., U.S. Pat. No. 8,383,346 and WO2010/144103).

Example 2

Preparation of HTP PGA-Containing Wet Cell Pellets

E. coli cells containing recombinant PGA-encoding genes from monoclonal colonies were inoculated into 180 μl LB containing 1% glucose and 30 μg/mL chloramphenicol in the wells of 96 well shallow well microtiter plates. The plates were sealed with $O_2$-permeable seals and cultures were grown overnight at 30° C., 200 rpm and 85% humidity. Then, 10 μl of each of the cell cultures were transferred into the wells of 96 well deep well plates containing 390 mL TB and 30 μg/mL CAM. The deep-well plates were sealed with $O_2$-permeable seals and incubated at 30° C., 250 rpm and 85% humidity until OD600 0.6-0.8 was reached. The cell cultures were then induced by IPTG to a final concentration of 1 mM and incubated overnight under the same conditions as originally used. The cells were then pelleted using centrifugation at 4000 rpm for 10 min. The supernatants were discarded and the pellets frozen at −80° C. prior to lysis.

Example 3

Preparation of HTP PGA-Containing Cell Lysates

First, 200 μl lysis buffer containing 10 mM Tris-HCl buffer, pH 7.5, 1 mg/mL lysozyme, and 0.5 mg/mL PMBS was added to the cell paste in each well produced as described in Example 2. The cells were lysed at room temperature for 2 hours with shaking on a bench top shaker. The plate was then centrifuged for 15 min at 4000 rpm and 4° C. The clear supernatants used in biocatalytic reactions to determine their activity levels.

Example 4

Preparation of Lyophilized Lysates from Shake Flask (SF) Cultures

Selected HTP cultures grown as described above were plated onto LB agar plates with 1% glucose and 30 µg/ml CAM and grown overnight at 37° C. A single colony from each culture was transferred to 6 ml of LB with 1% glucose and 30 µg/ml CAM. The cultures were grown for 18 h at 30° C., 250 rpm, and subcultured approximately 1:50 into 250 ml of TB containing 30 µg/ml CAM, to a final $OD_{600}$ of 0.05. The cultures were grown for approximately 195 minutes at 30° C., 250 rpm, to an $OD_{600}$ between 0.6-0.8 and induced with 1 mM IPTG. The cultures were then grown for 20 h at 30° C., 250 rpm. The cultures were centrifuged 4000 rpm×20 min. The supernatant was discarded, and the pellets were resuspended in 30 ml of 20 mM TRIS-HCl, pH 7.5. The cells were pelleted (4000 rpm×20 min) and frozen at −80° C. for 120 minutes. Frozen pellets were resuspended in 30 ml of 20 mM TRIS-HCl pH 7.5, and lysed using a Microfluidizer system (Microfluidics) at 18,000 psi. The lysates were pelleted (10,000 rpm×60 min) and the supernatants were frozen and lyophilized to generate shake flake (SF) enzymes.

Example 5

Improvements Over SEQ ID NO: 8 in the Deacylation of Tri-Protected Insulin at the B29 Position SEQ ID NO: 8 was selected as the parent enzyme after screening variants disclosed in U.S. Prov. Pat. Appln. Ser. No. 62/158,118 for the production of the B29 deacylated product. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3. Each variant was screened in a 200 µL reaction that comprised of 5 g/L A1/B1/B29 tri-phenyl acetate insulin, 200 mM Tris buffer pH=8.3 and 40 µL crude lysate for 3 hours at 30° C. The 96-well plates were heat-sealed and incubated in a Thermotron® shaker at 100 rpm. The reactions were quenched with 200 µl acetonitrile or dimethylacetamide and mixed for 5 minutes using a bench top shaker. The plates were then centrifuged at 4000 rpm for 5 minutes, diluted 2-fold into water, and loaded into an HPLC for analysis.

Activity relative to SEQ ID NO:8 (Activity FIOP) was calculated as the percent conversion of the product formed by the variant over the percent conversion produced by SEQ ID NO: 8 and shown in Table 5.1. The percent conversion was calculated by dividing the area of the product peak by the sum of the areas of the substrate, product and impurities/side product peaks as observed by the HPLC analysis.

TABLE 5.1

Activity of Variants Relative to SEQ ID NO: 8

| SEQ ID NO: (nt/aa) | Amino Acid Differences (Relative to SEQ ID NO: 8) | Activity FIOP [1] (Relative to SEQ ID NO: 8) |
|---|---|---|
| 9/10 | G71C; D74G | + |
| 11/12 | Y27T; G71H; D74G; D484N; Q547K; Y584F; M697L | + |
| 13/14 | Y27T; V28A; G71H; D74G; Q547K | + |
| 39/40 | L253Y | + |
| 41/42 | Y27T | + |
| 29/30 | S386G; K390S | + |
| 17/18 | L387K; K390S | + |
| 81/82 | A474C | + |
| 45/46 | S386A; K390S | + |
| 69/70 | S386H | + |
| 15/16 | S704N | + |
| 27/28 | F254N | + |
| 63/64 | A470C | + |
| 31/32 | A373R | + |
| 23/24 | T352K | + |
| 59/60 | L253H | + |
| 37/38 | A616Y | + |
| 55/56 | S372L | + |
| 19/20 | A451K | + |
| 77/78 | I708L | + |
| 43/44 | F256Y | + |
| 35/36 | L387R; K390S | + |
| 21/22 | D623Q | + |
| 47/48 | A467W | + |
| 53/54 | D623K | + |
| 73/74 | N348H | + |
| 51/52 | F254K | + |
| 49/50 | S706T | + |
| 33/34 | S374T | + |
| 83/84 | Q380M | + |
| 75/76 | T129W | + |
| 67/68 | Q380Y; N457L | + |
| 57/58 | A470E | + |
| 61/62 | N457A | + |
| 25/26 | D623A | + |
| 65/66 | N457Q | + |
| 79/80 | F256S | + |
| 71/72 | A373K | + |

[1] Levels of increased activity were determined relative to the reference polypeptide of SEQ ID NO: 8 and defined as follows: "+" > than 1-fold but less than 2.0-fold increased activity; "++" > than 2.0-fold but less than 3-fold increased activity; "+++" > than 3-fold increased activity but less than 10-fold; "++++" > than 10 fold.

Example 6

Improvements Over SEQ ID NO: 14 in the Deacylation of Tri-Protected Insulin at the B29 Position SEQ ID NO: 14 was selected as the parent enzyme after screening variants described in Example 5. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3.

Each variant was screened in a 200 µL reaction that comprised of 10 g/L A1/B1/B29 tri-phenyl acetate insulin, 200 mM Tris buffer pH=8.3 and 20 µL crude lysate for 24 hours at 30° C. The 96-well plates were heat-sealed and incubated in a thermotron shaker at 100 rpm. The reactions were quenched with 200 µl acetonitrile or dimethylacetamide and mixed for 5 minutes using a bench top shaker. The plates were then centrifuged at 4000 rpm for 5 minutes, diluted 2-fold into water, and loaded into an HPLC for analysis.

Activity relative to SEQ ID NO:14 (Activity FIOP) was calculated as the percent conversion of the product formed by the variant over the percent conversion produced by SEQ ID NO: 14 and shown in Table 6.1. The percent conversion was calculated by dividing the area of the product peak by the sum of the areas of the substrate, product and impurities/side product peaks as observed by the HPLC analysis.

TABLE 6.1

Activity of Variant Relative to SEQ ID NO: 14

| SEQ ID NO: (nt/aa) | Amino Acid Differences (Relative to SEQ ID NO: 14) | Activity FIOP [1] (Relative to SEQ ID NO: 14) |
|---|---|---|
| 419/420 | N185D | + |
| 433/434 | T560G | + |
| 443/444 | A517K | + |
| 415/416 | G415H | + |
| 441/442 | G444K | + |
| 417/418 | G444T | + |
| 421/422 | R748D | + |
| 439/440 | G444R | + |
| 447/448 | T443D | + |
| 423/424 | G444S | + |
| 427/428 | S492G/G493C | + |
| 431/432 | N9D | + |
| 437/438 | G444Q | + |
| 429/430 | R748S | + |
| 435/436 | K723D | + |
| 445/446 | R748E | + |
| 425/426 | G444L | + |
| 165/166 | N9S; K103E; W119Y; T131D; Q233K; T269R; K304Q; G444N; N494D; S646D | + |
| 177/178 | K103E; G444N; N494D; S646D | + |
| 119/120 | K103E; W119Y; T131D; Q233K; K273A; K304Q; A324T; Q432E; G444N; N494D; S646D | + |
| 211/212 | K103E; W119Y; Q233K; E312A; S646D | + |
| 207/208 | N9S; K103E; W119Y; T131D; K304Q; A324T; Q432E; G444N; N494D; S646D | + |
| 149/150 | W119Y; Q233K; K304Q; E312A; A324T; Q432E; G444N; S646D | + |
| 175/176 | K103E; T131D; Q233K; K304Q; A324T; G444N; S646D | + |
| 85/86 | K103E; W119Y; N494D; S646D; K661Q | + |
| 111/112 | N9S; W119Y; T131A; Q233K; N494D; S646D | + |
| 125/126 | K103E; W119Y; Q233K; K304Q; S646D | + |
| 173/174 | N9S; K103E; W119Y; Q233K; S646D | + |
| 215/216 | K103E; Q233K; K273A; E312A; Q432E; G444N; S646D | + |
| 133/134 | N9S; W119Y; Q233K; N494D; S646D | + |
| 155/156 | W119Y; K273A; A324T; G444N; N494D; S646D | + |
| 181/182 | N9S; W119Y; T131A; Q233K; K304Q; G444N; S646D | + |
| 121/122 | K103E; W119Y; T131A; Q233K; K304Q; E312A; Q432E; N494D; S646D; K661Q | + |
| 163/164 | W119Y; Q233K; K304Q; S646D | + |
| 115/116 | N9S; W119Y; K304Q; G444N; N494D; S646D | + |
| 109/110 | N9S; W119Y; Q233K; T269R; K273A; K304Q; E312A; Q432E; G444N; S646D | + |
| 123/124 | W119Y; E312A; G444N; S646D | + |
| 113/114 | N9S; W119Y; T131A; E312A; G444N; S646D | + |
| 143/144 | K103E; E312A; G444N; S646D | + |
| 103/104 | K103E; W119Y; S646D | + |
| 135/136 | W119Y; Q233K; S646D | + |
| 129/130 | K103E; W119Y; Q233K | + |
| 167/168 | W119Y; T131A; G444N; S646D; K661Q | + |
| 157/158 | W119Y; Q432E; G444N; S646D | + |
| 189/190 | K103E; T269R; K273A; G444N; S646D | + |
| 159/160 | N9S; T131A; Q233K; T269R; K273A; E312A; Q432E; G444N; S646D | + |
| 183/184 | K103E; K273A; K304Q; A324T; G444N; N494D | + |
| 105/106 | E312A; G444N; S646D | + |
| 127/128 | N9S; Q233K; N494D; S646D | + |
| 221/222 | N9S; Q233K; K304Q; N494D; S646D | + |
| 191/192 | T131D; K273A; Q432E; G444N; N494D; S646D | + |
| 219/220 | N9S; Q432E; G444N; N494D; S646D | + |
| 171/172 | N9S; Q233K; K273A; K304Q; N494D; S646D | + |
| 169/170 | K103E; Q233K; K273A; E312A; A324T; Q432E; G444N; S646D | + |
| 97/98 | N9S; K103E; Q233K; N494D | + |
| 201/202 | W119Y; T269R; K273A; E312A; Q432E; G444N; S646D | + |
| 187/188 | T131A; Q233K; K304Q; G444N | + |
| 101/102 | N9S; K103E; W119Y; N494D | + |
| 197/198 | K103E; T131D; T269R; K273A; G444N; S646D | + |
| 91/92 | N9S; W119Y; T131D; Q233K; N494D; K661Q | + |
| 205/206 | K103E; W119Y; T131A; T269R; E312A; N494D; S646D | + |
| 223/224 | N9S; K103E; W119Y; T131A; Q233K; E312A; A34T; Q432E; G444N; N494D | + |
| 213/214 | N9S; W119Y; T131A; Q432E; G444N; S646D | + |
| 145/146 | G444N; N494D | + |
| 95/96 | W119Y; T131A; N494D | + |

TABLE 6.1-continued

Activity of Variant Relative to SEQ ID NO: 14

| SEQ ID NO: (nt/aa) | Amino Acid Differences (Relative to SEQ ID NO: 14) | Activity FIOP [1] (Relative to SEQ ID NO: 14) |
|---|---|---|
| 93/94 | N9S; K103E; K304Q; Q432E; G444N; S646D | + |
| 185/186 | K304Q; E312A; G444N; S646D | + |
| 147/148 | W119Y; T131A; S646D | + |
| 139/140 | G444N; S646D | + |
| 89/90 | K273A; E312A; G444N; S646D | + |
| 199/200 | W119Y; Q233K; E312A | + |
| 137/138 | T131A; Q233K; K273A; S646D | + |
| 153/154 | N9S; E312A; G444N; S646D | + |
| 161/162 | N9S; W119Y; T131D; Q233K | + |
| 195/196 | E312A; S646D | + |
| 193/194 | N9S; K103E; T269R; K304Q; A324T; N494D; S646D | + |
| 107/108 | W119Y; T131D; K304Q; Q432E; G444N; S646D; K661Q | + |
| 131/132 | W119Y; T131D; G444N | + |
| 209/210 | T131A; Q233K; Q432E; S646D | + |
| 99/100 | N9S; Q233K; E312A; Q432E; S646D | + |
| 141/142 | N9S; K103E; Q233K; E312A; S646D | + |
| 117/118 | K103E; W119Y; Q233K; K273A; Q432E | + |
| 179/180 | Q233K; T269R; K304Q; E312A; A324T; Q432E; G444N; S646D | + |
| 217/218 | N9S; K103E; W119Y; T131A; A324T; Q432E; N494D; S646D | + |
| 203/204 | N9S; N494D; S646D | + |
| 87/88 | N9S; K103E; Q233K; Q432E; S646D | + |
| 151/152 | W119Y; T269R; K273A; E312A; A324T; N494D; S646D | + |
| 237/238 | L253Y; F256Y; T352K; A451K; | +++ |
| 299/300 | L253Y; T352K; A373R; S374T; A451K; A616Y | +++ |
| 271/272 | L253H; F256Y; T352K; A373R; S374T; A616Y | ++ |
| 321/322 | F256Y; S374T; Q380L; A451K; A616Y | ++ |
| 307/308 | Q380L; A451K; A616Y | ++ |
| 323/324 | L253H; T352K; A451K; A616Y | ++ |
| 243/244 | L253Y; F256Y; T352K; S374T; Q380L; A451K | ++ |
| 293/294 | F254N; A373R; S374T; A451K | ++ |
| 273/274 | T352K; A373R; S374T; A451K | ++ |
| 337/338 | L253Y; T352K; A373R; S374T; A451K | ++ |
| 227/228 | L253H; A451K; N457S | ++ |
| 325/326 | L253Y; F256Y; T352K; S374T; A451K | ++ |
| 333/334 | L253H; T352K; S374T; A616Y | ++ |
| 363/364 | L253Y; A373R; S374T; A451K; A616Y | ++ |
| 275/276 | T352K; S374T; A451K | ++ |
| 331/332 | L253Y; F254N; T352K; S374T; Q380L | ++ |
| 343/344 | S374T; A451K; A616Y | ++ |
| 295/296 | A451K; A616Y | ++ |
| 351/352 | T352K; S374T; Q380L; A451K; A616Y | ++ |
| 367/368 | T352K; Q380L; A451K; A616Y | ++ |
| 349/350 | L253Y; T352K; S374T; A616Y | ++ |
| 401/402 | L253H; F256Y; T352K; Q380L; A451K; A616Y | ++ |
| 289/290 | T352K; A451K; A616Y | ++ |
| 381/382 | L253Y; F256Y; A373R | ++ |
| 383/384 | L253H; F256Y; S374T; A616Y | ++ |
| 253/254 | S374T; Q380L; A451K | ++ |
| 335/336 | S374T; Q380L; A451K; D623N | ++ |
| 355/356 | L253Y; F256Y; T352K; Q380L | ++ |
| 405/406 | T352K; S374T; A616Y | ++ |
| 225/226 | F254N; T352K; Q380L; A451K | ++ |
| 231/232 | A373R; S374T; A451K | ++ |
| 379/380 | F254N; A616Y | ++ |
| 393/394 | L253H; F256Y; Q380L; A451K; A616Y | ++ |
| 399/400 | F254N; A373R; S374T; Q380L; A451K | ++ |
| 411/412 | L253H; F256Y; T352K; S374T; Q380L; A451K | ++ |
| 263/264 | F254N; F256Y; S374T; A451K | ++ |
| 341/342 | S374T; A616Y | ++ |
| 283/284 | L253H; S374T; A451K | ++ |
| 375/376 | F256Y; S374T; A616Y | ++ |
| 339/340 | F254N; T352K; A451K | ++ |
| 407/408 | L253Y; F256Y; Q380L | ++ |
| 373/374 | F256Y; T352K; S374T | ++ |
| 409/410 | L253H; S374T; A451K; D623Q | ++ |
| 285/286 | L253Y; T352K; D623N | ++ |
| 279/280 | Q380L; A451K; D623A | ++ |
| 269/270 | F254N; A451K | ++ |
| 257/258 | T352K; Q380L; A451K; D623Q | ++ |
| 403/404 | T352K; A373R; A451K | ++ |
| 359/360 | T352K; S374T | ++ |
| 345/346 | Q380L; A616Y | ++ |
| 305/306 | L253H; F256Y | ++ |
| 245/246 | S374T; A451K | ++ |

TABLE 6.1-continued

Activity of Variant Relative to SEQ ID NO: 14

| SEQ ID NO: (nt/aa) | Amino Acid Differences (Relative to SEQ ID NO: 14) | Activity FIOP [1] (Relative to SEQ ID NO: 14) |
|---|---|---|
| 377/378 | L253Y; F256Y | ++ |
| 385/386 | T352K; S374T; Q380L | ++ |
| 365/366 | L253H; A373R; A451K | ++ |
| 287/288 | L253Y; Q380L | ++ |
| 291/292 | Q380L; A451K | ++ |
| 353/354 | F254N; F256Y; Q380L; A451K; A616Y | ++ |
| 313/314 | F254N; S374T | ++ |
| 309/310 | F254N; S374T; Q380L | ++ |
| 239/240 | T352K; Q380L; A616Y | ++ |
| 361/362 | T352K; Q380L; A451K | ++ |
| 387/388 | L253H; F256Y; S374T; A451K | ++ |
| 249/250 | A373R; S374T | ++ |
| 371/372 | L253H; A451K | ++ |
| 255/256 | L253Y; F256Y; Q380L; A451K; H546Y; A616Y | + |
| 327/328 | T352K; A616Y | + |
| 267/268 | A616Y | + |
| 347/348 | F256Y; T352K; Q380L; A451K; A616Y | + |
| 329/330 | S374T; Q380L | + |
| 311/312 | S374T; D623Q | + |
| 281/282 | F254N; F256Y; A373R; S374T; Q380L; A451K | + |
| 235/236 | T352K; A451K | + |
| 319/320 | T352K; A373R; Q380L; A451K; A616Y | + |
| 229/230 | D623A | + |
| 413/414 | Q380L; A616Y; D623Q | + |
| 265/266 | A373R; A451K | + |
| 251/252 | S374T | + |
| 395/396 | F254N; F256Y; T352K; A451K | + |
| 397/398 | A451K; D623N | + |
| 247/248 | F254N; F256Y; S374T | + |
| 233/234 | L253H | + |
| 317/318 | F254N; A255E; T352K | + |
| 369/370 | A28S; S374T; Q380L | + |
| 301/302 | F254N; T352K; Q380L | + |
| 261/262 | F254N; Q380L | + |
| 241/242 | A451K | + |
| 277/278 | T352K | + |
| 259/260 | T352K; Q380L | + |
| 389/390 | D623N | + |
| 391/392 | D623Q | + |
| 303/304 | T352K; A373R; Q380L; A451K | + |
| 297/298 | Q380L | + |
| 357/358 | F254N; F256Y; A451K | + |
| 315/316 | A373R; A616Y | + |
| 451/452 | N457Q; A470C | + |
| 455/456 | T129W; F254K; N348H; N457Q; S704N | + |
| 467/468 | N348H; S372L; A470E; D623K; I708L | + |
| 457/458 | N457Q; S704N; I708L | + |
| 483/484 | T129W; D623K | + |
| 453/454 | N457Q | + |
| 485/486 | T129W; N348H | + |
| 461/462 | N348H | + |
| 449/450 | N348H; S704N; I708L | + |
| 459/460 | T129W; Q380M; A470E | + |
| 469/470 | T129W; N457Q; A470C; A474C | + |
| 471/472 | T129W; N348H; A470E; D623K; S704N; S706T; I708L | + |
| 475/476 | T129W; N348H; A467W; A470C; S704N; I708L | + |
| 477/478 | S372L; N457Q; A470E; D623K | + |
| 479/480 | D623K | + |
| 481/482 | A470C; I708L | + |
| 465/466 | T129W; N348H; A470E; D623K; S704N; S706T | + |
| 463/464 | T129W; A470E | + |
| 473/474 | Q380M; D623K | + |

[1] Levels of increased activity were determined relative to the reference polypeptide of SEQ ID NO: 14 and defined as follows: "+" = greater than 1-fold but less than 2.0-fold increased activity; "++" = greater than 2.0-fold but less than 3-fold increased activity; "+++" = greater than 3-fold increased activity but less than 10-fold; "++++" = greater than 10 fold.

Example 7

Improvements Over SEQ ID NO:300 in the Deacylation of Tri-Protected Insulin at the B29 Position SEQ ID NO: 300 was selected as the parent enzyme after screening variants described in Example 6. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3.

Each variant was screened in a 200 μL reaction that comprised of 50 g/L A1/B1/B29 tri-phenyl acetate insulin, 200 mM Tris buffer pH=8.3 and 2.5 μL crude lysate for 24 hours at 30° C. The 96-well plates were heat-sealed and incubated in a thermotron shaker at 100 rpm. The reactions were quenched with 200 μl acetonitrile or dimethylacetamide and mixed for 5 minutes using a bench top shaker. The plates were then centrifuged at 4000 rpm for 5 minutes, diluted 2-fold into water, and loaded into an HPLC for analysis.

Activity relative to SEQ ID NO:300 (Activity FIOP) was calculated as the percent conversion of the product formed by the variant over the percent conversion produced by SEQ ID NO: 300 and shown in Table 7.1. The percent conversion was calculated by dividing the area of the product peak by the sum of the areas of the substrate, product and impurities/side product peaks as observed by the HPLC analysis.

TABLE 7.1

Activity of Variants Relative to SEQ ID NO: 300

| SEQ ID NO: (nt/aa) | Amino Acid Differences (Relative to SEQ ID NO: 300) | Activity FIOP [1] (Relative to SEQ ID NO: 300) |
|---|---|---|
| 837/838 | N9D; N185D; G415H; G444T; A517K; T560G; K723D; R748E | +++ |
| 813/814 | N9D; N185D; G415H; T443D; G444R; A517K; K723D; R748D | +++ |
| 775/776 | N9D; G415H; T443D; T560G; K723D; R748D | +++ |
| 839/840 | N9D; G415H; G444L; T560G; K723D; R748E | +++ |
| 719/720 | N9D; G415H; T443D; G444R; T560G; K723D; R748E | +++ |
| 797/798 | G415H; T443D; A517K; T560G; K723D | +++ |
| 695/696 | N9D; G415H; T443D; G444T; A517K; T560G; K723D | +++ |
| 767/768 | N9D; N185D; G415H; G444S; K723D; R748E | +++ |
| 597/598 | N9D; N185D; G415H; T443D; G444T; A517K; T560G | +++ |
| 561/562 | N9D; N185D; G415H; G444L; A517K; T560G; K723D; R748S | +++ |
| 827/828 | N185D; G415H; T443D; G444R; A517K; T560G | +++ |
| 771/772 | N185D; G415H; G444T; T560G | +++ |
| 773/774 | N9D; N185D; T443D; G444K; T560G; K723D | +++ |
| 765/766 | G415H; T443D; G444T; T560G | +++ |
| 769/770 | G415H; G444Q; T560G; K723D | +++ |
| 791/792 | N9D; G415H; A517K; T560G; K723D; R748D | +++ |
| 783/784 | G415H; A517K; T560G; K723D; R748D | +++ |
| 673/674 | N185D; G415H; T443D; G444T; A517K | ++ |
| 545/546 | N9D; G415H; G444Q; A517K; T560G; K723D; R748S | ++ |
| 727/728 | N9D; N185D; G415H; T443N; G444K; A517K; R748E | ++ |
| 599/600 | N9D; G415H; G444L; A517K; T560G; K723D; R748D | ++ |
| 633/634 | N9D; G415H; T443D; G444S; A517K; T560G | ++ |
| 651/652 | N9D; G415H; T443D; G444T; A517K; R748S | ++ |
| 683/684 | N9D; G415H; G444T; A517K; T560G; K723D | ++ |
| 817/818 | G415H; G444S; A517K; K723D; R748E | ++ |
| 671/672 | N9D; G415H; G444Q; T560G; K723D | ++ |
| 557/558 | N9D; N185D; G415H; G444K; A517K; K723D; R748E | ++ |
| 627/628 | N185D; G415H; G444R; A517K; T560G; R748D | ++ |
| 699/700 | N9D; G415H; T443D; G444K; A517K; T560G | ++ |
| 679/680 | N9D; G415H; A517K; T560G; K723D; R748E | ++ |
| 569/570 | N9D; T443D; G444K; T560G; K723D; R748D | ++ |
| 589/590 | G415H; G444Q; A517K; T560G; K723D; R748S | ++ |
| 573/574 | G415H; G444S; A517K; T560G; K723D | ++ |
| 799/800 | N9D; N185D; G415H; G444K; A517K; R748D | ++ |
| 525/526 | G415H; T443D; G444T; A517K; R748E | ++ |
| 639/640 | G415H; T443D; A517K; K723D | ++ |
| 807/808 | N9D; N185D; G444Q; A517K; T560G; K723D | ++ |
| 749/750 | N9D; N185D; G444T; A517K; T560G; K723D | ++ |
| 619/620 | N9D; T443D; G444K; A517K; T560G; K723D | ++ |
| 543/544 | N185D; G415H; T560G; K723D | ++ |
| 779/780 | N9D; G415H; G444L; K723D; R748S | ++ |
| 707/708 | N9D; N185D; G415H; G444L; A517K; T560G | ++ |
| 725/726 | N9D; N185D; T443D; G444K; A517K; T560G | ++ |
| 523/524 | N9D; G415H; G444T; T560G; S665R; K723D; R748S | ++ |
| 713/714 | G415H; G444S; T560G; R748E | ++ |
| 587/588 | N9D; N185D; T443D; G444S; K723D | ++ |
| 539/540 | N9D; N185D; G415H; G444Q; T560G | ++ |
| 551/552 | G415H; G444Q; A517K; T560G; R748S | ++ |
| 553/554 | N9D; G415H; G444T; K723D; R748E | ++ |
| 741/742 | N9D; G415H; G444R; A517K; T560G; R748E | ++ |
| 595/596 | N9D; G415H; T443D; G444R; A517K; R748E | ++ |
| 655/656 | N9D; N185D; G415H; A517K; K723D | ++ |
| 641/642 | N9D; N185D; G444Q; A517K; T560G; R748D | ++ |

TABLE 7.1-continued

Activity of Variants Relative to SEQ ID NO: 300

| SEQ ID NO: (nt/aa) | Amino Acid Differences (Relative to SEQ ID NO: 300) | Activity FIOP [1] (Relative to SEQ ID NO: 300) |
|---|---|---|
| 751/752 | G415H; G444S; T560G | ++ |
| 491/492 | N9D; G415H; T443D; T560G | ++ |
| 823/824 | N9D; G444L; A517K; T560G; K723D; R748E | ++ |
| 717/718 | N9D; N185D; G415H; A517K; T560G | ++ |
| 611/612 | N185D; G415H; K723D; R748S | ++ |
| 593/594 | N9D; G415H; G444T; T560G | ++ |
| 745/746 | N9D; N185D; A517K; T560G; K723D; R748E | ++ |
| 575/576 | G415H; T560G; K723D | ++ |
| 643/644 | N9D; T443D; G444R; T560G; K723D | ++ |
| 609/610 | N9D; T443D; G444T; A517K; T560G | ++ |
| 515/516 | G415H; A517K; T560G; R748E | ++ |
| 489/490 | N9D; G415H; G444K; A517K; T560G; R748S | ++ |
| 583/584 | N9D; G415H; G444S; T560G | ++ |
| 601/602 | N185D; G444R; A517K; T560G; K723D; R748S | ++ |
| 715/716 | N185D; G415H; T560G | ++ |
| 735/736 | N185D; G415H; G444R; A517K; R748S | ++ |
| 513/514 | N9D; G415H; A517K; T560G; R748E | ++ |
| 511/512 | N9D; G61D; G444S | ++ |
| 617/618 | G415H; G444K; K723D | ++ |
| 733/734 | N9D; N185D; G444L; T560G; K723D | ++ |
| 675/676 | G415H; K723E; R748E | ++ |
| 723/724 | N9D; G415H; G444R; T560G | ++ |
| 665/666 | N185D; T443D; G444R; T560G | ++ |
| 607/608 | N9D; G444N; A517K; T560G; K723D; R748E | ++ |
| 653/654 | N9D; N185D; G415H; A517K; R748S | ++ |
| 647/648 | N9D; G444Q; A517K; T560G; K723D | ++ |
| 509/510 | N9D; N185D; G444S; A517K; K723D; R748S | ++ |
| 691/692 | N9D; N185D; G415H; R748E | ++ |
| 787/788 | N9D; G415H; G444Q; A517K | ++ |
| 549/550 | G444L; A517K; T560G; K723D; R748S | ++ |
| 487/488 | N185D; A517K; T560G; K723D | ++ |
| 677/678 | T443D; G444T; K723D | ++ |
| 681/682 | T443D; G444K; A517K; R748E | ++ |
| 649/650 | N9D; N185D; G444L; T560G; R748S | ++ |
| 785/786 | N9D; G415H; G444K | ++ |
| 531/532 | N9D; N185D; G415H; G444Q | ++ |
| 621/622 | G415H; K723D; R748S | ++ |
| 819/820 | N185D; G444L; A517K; T560G | ++ |
| 795/796 | G415H; G444T | ++ |
| 625/626 | N9D; G415H; T560G | ++ |
| 687/688 | G444S; A517K; K723D; R748E | ++ |
| 585/586 | N9D; G444K; T560G; K723D | ++ |
| 499/500 | N9D; T443D; G444T; A517K; R748S | ++ |
| 541/542 | N9D; N185D; G444Q; A517K; T560G | ++ |
| 753/754 | N9D; N185D; G444S; T560G | ++ |
| 645/646 | N9D; N185D; G444L; A517K; T560G | ++ |
| 581/582 | N185D; G444S; A517K; K723D | ++ |
| 659/660 | N9D; G415H; G444L; A517K | ++ |
| 535/536 | T443D; G444S; T560G | ++ |
| 801/802 | N9D; N185D; G444S; K723D | ++ |
| 579/580 | N9D; T443D; G444K; T560G | ++ |
| 669/670 | G444T; T560G; K723D | ++ |
| 689/690 | G415H; G444L; A517K | ++ |
| 763/764 | N9D; N185D; T443D; G444R; A517K | ++ |
| 777/778 | N185D; T560G; K723D | ++ |
| 757/758 | N9D; T443D; K723D | ++ |
| 637/638 | N9D; T443D; G444S; A517K | ++ |
| 635/636 | N9D; G444L; T560G; K723D | ++ |
| 503/504 | N9D; G415H; G444S; A517K | ++ |
| 815/816 | N185D; T560G; R748E | ++ |
| 825/826 | N9D; Q168R; N185D; A517K; T560G; R748S | ++ |
| 781/782 | G444L; T560G; K723D | ++ |
| 667/668 | N9D; G444T; A517K; T560G | ++ |
| 743/744 | N9D; G444L; T560G; R748E | ++ |
| 711/712 | N9D; T443D; A517K; R748E | ++ |
| 563/564 | G444Q; T560G; K723D | ++ |
| 603/604 | N9D; N185D; G415H | ++ |
| 821/822 | G415H; G444L | ++ |
| 661/662 | N9D; G415H; G444R; A517K | ++ |
| 623/624 | N9D; A517K; T560G; K723D | ++ |
| 731/732 | G415H; R748E | ++ |
| 663/664 | N185D; T560G; R748S | ++ |
| 537/538 | N9D; T560G; K723D; R748S | ++ |
| 793/794 | G444Q; T560G | ++ |

TABLE 7.1-continued

Activity of Variants Relative to SEQ ID NO: 300

| SEQ ID NO: (nt/aa) | Amino Acid Differences (Relative to SEQ ID NO: 300) | Activity FIOP [1] (Relative to SEQ ID NO: 300) |
|---|---|---|
| 567/568 | N9D; G444L; T560G; R748S | + |
| 519/520 | N9D; G444S; T560G; R748E | + |
| 693/694 | N9D; G415H; R748S | + |
| 521/522 | N9D; G444Q; A517K; K723D | + |
| 755/756 | N185D; G444R; T560G | + |
| 709/710 | N9D; G415H; A517K | + |
| 615/616 | N9D; A517K; T560G; R748E | + |
| 547/548 | G444T; A517K; T560G | + |
| 729/730 | N9D; A517K; T560G; R748D | + |
| 803/804 | A517K; T560G; R748E | + |
| 555/556 | G444K; A517K; T560G | + |
| 497/498 | N9D; G444K; A517K; T560G | + |
| 831/832 | N9D; N185D; G444K | + |
| 591/592 | G415H; A517K | + |
| 613/614 | G444K; A517K; R748E | + |
| 737/738 | N185D; T560G | + |
| 739/740 | G444S; K723D | + |
| 493/494 | G444S; T560G; R748S | + |
| 835/836 | N9D; N185D; R748E | + |
| 829/830 | N9D; G444K; R748S | + |
| 809/810 | G415H | + |
| 701/702 | N9D; G444L; T560G | + |
| 685/686 | T443D; A517K | + |
| 705/706 | N9D; G444S; K723D | + |
| 501/502 | T443D; G444S | + |
| 761/762 | N9D; N185D; A517K | + |
| 629/630 | A517K; T560G | + |
| 805/806 | N9D; A517K; K723D | + |
| 833/834 | G444K; R748S | + |
| 505/506 | N9D; T443D; G444R; A517K | + |
| 507/508 | G444R; A517K; T560G | + |
| 747/748 | A517K; K723D | + |
| 571/572 | N9D; G444Q; A517K | + |
| 517/518 | K723D; R748D | + |
| 533/534 | N185D; G444K; K446N; A517K; T560G | + |
| 565/566 | N9D; G444L; R748E | + |
| 495/496 | T443D; G444K; A517K; T560G; K723D; R748S | + |
| 657/658 | N9D; K15M; G444L; K723D | + |
| 631/632 | N9D; G444T | + |
| 697/698 | N9D; A517K; R748S | + |
| 811/812 | N9D; N185D | + |
| 529/530 | N9D; K723D | + |
| 605/606 | A517K; R748E | + |
| 789/790 | K723D | + |
| 527/528 | G415H; A517K; T560G | + |
| 559/560 | T560G | + |
| 721/722 | G444K | + |
| 759/760 | G444R; A517K | + |
| 577/578 | N9D; A517K | + |
| 703/704 | A517K; R748S | + |
| 903/904 | K103E; W119Y; N348H; N457Q; N494D | +++ |
| 897/898 | K103E; W119Y; F256R; N348H; G444N; N494D; S646D | ++ |
| 877/878 | K103E; T129W; F254N; G444N; N457Q; N494D | ++ |
| 943/944 | K103E; W119Y; N348H; N457Q | ++ |
| 895/896 | K103E; W119Y; N457Q | ++ |
| 855/856 | W119Y; T129W; F256R; N348H; N457Q | ++ |
| 945/946 | W119Y; T129W; F254N; N457Q; N494D | ++ |
| 935/936 | K103E; F256R; N457Q | ++ |
| 881/882 | W119Y; F256R; N348H; N494D | ++ |
| 939/940 | N348H; N457Q | ++ |
| 911/912 | K103E; T129W; F256R; N348H | ++ |
| 923/924 | K103E; T129W; N348H; S646D | ++ |
| 871/872 | W119Y; F254N; N348H; N457Q | ++ |
| 933/934 | K103E; W119Y; F254N; N348H; G444N | ++ |
| 891/892 | W119Y; F256R; N348H | ++ |
| 929/930 | F256R; N348H | ++ |
| 841/842 | K103E; W119Y; N348H | + |
| 879/880 | K103E; N348H; N494D | + |
| 893/894 | K103E; N348H; G444N | + |
| 937/938 | K103E; W119Y; T129W; G444N; N494D | + |
| 941/942 | K103E; F256R; G444N | + |
| 915/916 | K103E; W119Y; F254N; G444N | + |
| 873/874 | F254N; N457Q | + |
| 899/900 | K103E; N348H | + |

TABLE 7.1-continued

Activity of Variants Relative to SEQ ID NO: 300

| SEQ ID NO: (nt/aa) | Amino Acid Differences (Relative to SEQ ID NO: 300) | Activity FIOP [1] (Relative to SEQ ID NO: 300) |
|---|---|---|
| 901/902 | K103E; W119Y; F254N; N348H | + |
| 865/866 | K103E; W119Y; N494D; S646D | + |
| 867/868 | K103E; F254N; N348H; N494D | + |
| 949/950 | N348H; G444N; S646D | + |
| 917/918 | W119Y; F256R; G444N | + |
| 845/846 | K103E; W119Y; F256R; N494D | + |
| 885/886 | K103E; F254N; N348H | + |
| 927/928 | W119Y; T129W; F254N; N348H; N494D | + |
| 883/884 | K103E; F254N; S646D | + |
| 849/850 | W119Y; N348H; N494D | + |
| 861/862 | W119Y; N348H | + |
| 913/914 | K103E; F256R; N494D | + |
| 925/926 | N348H; N494D | + |
| 859/860 | K103E; W119Y; N494D | + |
| 951/952 | W119Y; F256R | + |
| 857/858 | W119Y; N348H; G444N | + |
| 921/922 | K103E; T129W | + |
| 875/876 | K103E; G444N | + |
| 931/932 | K103E; F256R | + |
| 947/948 | K103E; N494D; S646D | + |
| 843/844 | N348H; G444N | + |
| 853/854 | K103E; N494D | + |
| 847/848 | K103E; W119Y | + |
| 909/910 | F256R; N494D | + |
| 905/906 | K103E; W119Y; T129W; F254N; F256R; N348H; N494D; S646D | + |
| 919/920 | K103E; F254N | + |
| 869/870 | W119Y; S646D | + |
| 887/888 | N348H | + |
| 863/864 | W119Y; G444N | + |
| 851/852 | W119Y; T129W; S646D | + |
| 907/908 | K103E | + |
| 889/890 | K103E; F254N; F256R; N348H; G444N; N494D | + |

[1] Levels of increased activity were determined relative to the reference polypeptide of SEQ ID NO: 300 and defined as follows: "+" = greater than 1-fold but less than 2.0-fold increased activity; "++" = greater than 2.0-fold but less than 3-fold increased activity; "+++" = greater than 3-fold increased activity but less than 10-fold; "++++" = greater than 10 fold.

Example 8

Improvements Over SEQ ID NO: 1262 or 1288 in the Deacylation of Tri-Protected Insulin at the A1 Position Screening of variants from the Codex® Acylase Panel (Codexis) and variants disclosed in U.S. Prov. Pat. Appln. Ser. No. 62/158,118, identified variants SEQ ID NO: 1262 and 1288 as the best enzymes removing the protecting group from A1/B1/B29 tri-phenyl acetate insulin at position A1. The variant comprising SEQ ID NO: 1262 was selected as the parent enzyme for libraries targeting improved activity and chemoselectivity for deacylation of tri-protected insulin at position A1. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3. Each variant was screened in a 200 µL reaction that comprised of 5 g/L A1/B1/B29 tri-phenyl acetate insulin, 0.1 M Tris-HCl buffer pH=8.0, 17 g/L methyl phenylacetate and 80 µL soluble lysate for 5 hours at 30° C. The 96-well plates were heat-sealed and incubated in a Thermotron® shaker at 100 rpm. The reactions were quenched with 300 µl acetonitrile and mixed for 5 minutes using a bench top shaker. The plates were then centrifuged at 4000 rpm for 5 minutes and loaded into an HPLC for analysis.

Percent conversion relative to SEQ ID NO:1262 or 1288 (Percent Conversion FIOP) was calculated as the percent conversion of the product formed by the variant over the percent conversion produced by SEQ ID NO: 1262 or 1288 and shown in Table 8.1 and 8.2. The percent conversion was calculated by dividing the area of the product peak by the sum of the areas of the substrate, product and impurities/side product peaks as observed by the HPLC analysis.

Percent selectivity relative to SEQ ID NO:1262 or 1288 (Percent Selectivity FIOP) was calculated as the percent selectivity of the product formed by the variant over the percent selectivity produced by SEQ ID NO: 1262 or 1288 and shown in Tables 8.1 and 8.2. The percent selectivity was calculated by dividing the area of the product peak by the sum of the areas of the product and impurities/side product peaks as observed by the HPLC analysis.

TABLE 8.1

Deacylation Results

| SEQ ID NO: (nt/aa) | Amino Acid Differences (Relative to SEQ ID NO: 1262) | Deacylation Percent Conversion FIOP [1] | Deacylation Percent Selectivity FIOP [2] |
|---|---|---|---|
| 953/954 | W431R | +++ | +++ |
| 955/956 | F701L | ++++++ | ++++++ |
| 957/958 | F701A | +++++ | ++++++ |
| 959/960 | F24A | +++++ | ++++++ |
| 961/962 | F71V | +++ | +++ |
| 963/964 | F71K | +++ | ++++ |
| 965/966 | F71E | ++++++ | ++++++ |
| 967/968 | F24Y; V28A | +++++ | +++++ |
| 969/970 | M697L | +++ | +++ |

TABLE 8.1-continued

Deacylation Results

| SEQ ID NO: (nt/aa) | Amino Acid Differences (Relative to SEQ ID NO: 1262) | Deacylation Percent Conversion FIOP [1] | Deacylation Percent Selectivity FIOP [2] |
|---|---|---|---|
| 971/972 | I177T | ++++ | ++++ |
| 973/974 | W154F; L754P | ++ | ++ |
| 975/976 | F71C; G74D | ++ | ++ |
| 977/978 | F701V | ++++++ | ++++++ |
| 979/980 | F701H | ++++++ | ++++++ |
| 981/982 | F701C | +++++ | ++++++ |
| 983/984 | F701I | ++++++ | ++++++ |
| 985/986 | F701M | ++++ | +++++ |
| 987/988 | M697F | ++ | ++ |
| 989/990 | M697G | ++++ | ++++ |
| 991/992 | V28A; Y31F | ++++++ | ++++++ |
| 993/994 | V28A; Y31L | ++++++ | ++++++ |
| 995/996 | V28A; Y31V | ++++++ | ++++++ |
| 997/998 | V28A; Y31T | ++++ | ++++ |
| 999/1000 | V28A; Y31C | +++++ | ++++++ |
| 1001/1002 | V28A; Y31N | ++++++ | ++++++ |
| 1003/1004 | V28A; Y31M | ++++++ | ++++++ |
| 1005/1006 | V28A; Y31K | ++++++ | ++++++ |
| 1007/1008 | F24A; Y31W; V56I; F701W | ++++++ | ++++++ |
| 1009/1010 | F24A; V56I; F701W | ++++++ | ++++++ |
| 1011/1012 | F24A; Y31C; V56I; S386P; F701Y | ++ | ++++++ |
| 1013/1014 | F24A; F71C; F701W | ++++ | ++++++ |
| 1015/1016 | F24A; L225V; F701Y | +++ | ++++++ |
| 1017/1018 | F24A; Y31W; V56T; V264A; F701W; S750G | ++++++ | ++++++ |
| 1019/1020 | F24A; Y31W; F71C; F701W | +++ | ++++++ |
| 1021/1022 | F24A; D484N; F701W | ++++++ | ++++++ |
| 1023/1024 | F24A; V56T; F701W | +++++ | ++++++ |
| 1025/1026 | F24A; Y31W | ++++++ | ++++++ |
| 1027/1028 | F24A; V56I; W154F; I270V; M697L | +++ | ++++++ |
| 1029/1030 | F24A; V56I; M697F; F701W | +++ | ++++++ |
| 1031/1032 | F24A; Y31W; V56I; F701Y | ++++ | ++++++ |
| 1033/1034 | F24A; Y31W; V56I; M697L | ++++++ | ++++++ |
| 1035/1036 | F24Y; V28A; F71C; F701W | ++++++ | ++++++ |
| 1037/1038 | F24Y; V28A; V56I; A308T; T379A; F701W | ++++++ | ++++++ |
| 1039/1040 | F24Y; V28A; D321N; F701H | ++++++ | ++++++ |
| 1041/1042 | F24Y; V28A; N457Y; F701W | ++++++ | ++++++ |
| 1043/1044 | F24Y; V28A; V56I; F701W | ++++++ | ++++++ |
| 1045/1046 | F24Y; Y27C; V28T; F701W; V729F | ++++++ | ++++++ |
| 1047/1048 | V56T; F71G; F701W | ++++++ | ++++++ |
| 1049/1050 | M697L; F701Y | ++++ | ++++ |
| 1051/1052 | V56T; W658R; F701W | ++ | ++ |
| 1053/1054 | V56T; F71G; F701I | ++++ | ++++++ |
| 1055/1056 | A410P; M697F; F701W | +++++ | ++++++ |
| 1057/1058 | V56L; K322R; M697L; F701V | +++++ | ++++++ |
| 1059/1060 | V56L; F701H | ++++++ | ++++++ |
| 1061/1062 | Y31C; V56L; F701H | ++++++ | ++++++ |
| 1063/1064 | F71G; F701W | ++++++ | ++++++ |
| 1065/1066 | T129A; I511F; F701Y | ++++ | +++++ |
| 1067/1068 | V56T; F701W; L711Q | ++ | ++ |
| 1069/1070 | I423T; F701W | ++ | ++ |
| 1071/1072 | V56I; W154F; F701W | +++ | +++ |
| 1073/1074 | V56L; W119R; K146E; F701Y | ++++ | ++++++ |
| 1075/1076 | V56T; M697L; F701W | ++++++ | ++++++ |

[1] The percent conversion for each variant was determined relative to the reference polypeptide of SEQ ID NO: 1262 and defined as follows: "+" = greater than 1-fold but less than 2.0-fold increased activity; "++" = greater than 2.0-fold but less than 3-fold increased activity; "+++" = greater than 3-fold increased activity but less than 4-fold; "++++" = greater than 4-fold but less than 5-fold; "+++++" = greater than 5-fold but less than 6-fold; "++++++" = greater than 6-fold.
[2] The percent selectivities for each variant was determined relative to the reference polypeptide of SEQ ID NO: 1262 and defined as follows: "+" = greater than 1-fold but less than 2.0-fold increased selectivity; "++" = greater than 2.0-fold but less than 3-fold increased selectivity; "+++" = greater than 3-fold increased selectivity but less than 4-fold increase selectivity; "++++" = greater than 4-fold but less than 5-fold increase selectivity; "+++++" = greater than 5-fold but less than 6-fold increased selectivity; "++++++" = greater than 6-fold selectivity.

TABLE 8.2

Deacylation Results

| SEQ ID NO: (nt/aa) | Amino Acid Differences (Relative to SEQ ID NO: 1288) | Deacylation Percent Conversion FIOP[1] | Deacylation Percent Selectivity FIOP[2] |
|---|---|---|---|
| 1077/1078 | G71Y; D74K | +++++ | ++++++ |
| 1079/1080 | Y31A | + | +++ |
| 1081/1082 | G71K; D74L | + | +++ |
| 1083/1084 | G71K; D74N; T129P | + | +++ |
| 1085/1086 | T32R | + | ++++ |
| 1087/1088 | A69L; D74T | + | +++ |
| 1089/1090 | V75H | + | ++ |
| 1091/1092 | R141A | + | +++ |
| 1093/1094 | P22C | + | ++++ |
| 1095/1096 | F57W | + | ++++ |
| 1097/1098 | G71E | + | +++++ |
| 1099/1100 | G71E; D74T | +++ | ++++ |
| 1101/1102 | G71W; D74T | +++ | ++++ |
| 1103/1104 | G71W; D74G | +++ | ++++ |
| 1105/1106 | G71W; D74S | +++ | ++++ |
| 1107/1108 | G71D; D74H | +++ | ++++ |
| 1109/1110 | G71D; D74M | +++ | ++++ |
| 1111/1112 | G71D; D74L | +++ | ++++ |
| 1113/1114 | G71E; D74T; A470V | ++ | +++ |
| 1115/1116 | G71W | ++ | ++++ |
| 1117/1118 | G71D | +++ | ++++ |
| 1119/1120 | K394Y | ++ | ++++ |
| 1121/1122 | G71H; D74M | ++ | +++ |
| 1123/1124 | G71I; D74Q; G145S | ++ | ++ |
| 1125/1126 | G71H; D74H | ++ | +++ |
| 1127/1128 | F50W | + | ++ |
| 1129/1130 | G71I; A149V | + | ++ |
| 1131/1132 | G71N; D74Q | ++ | ++ |
| 1133/1134 | G71N; D74A | + | ++ |
| 1135/1136 | G71H | ++ | ++ |
| 1137/1138 | Y31L; V56I; V264A; A308T; T379A; D484N; Q547K; L711Q; S750G | + | ++ |
| 1139/1140 | G71N; D74V; Y248C | + | ++ |
| 1141/1142 | G71H; D74G | ++ | ++ |
| 1143/1144 | G71H; D74P | ++ | +++ |
| 1145/1146 | G71N; D74S | ++ | ++ |
| 1147/1148 | G71F; D74E | ++ | ++ |
| 1149/1150 | G71Y; D74L | +++ | +++ |
| 1151/1152 | G71H; D74S | ++ | ++ |
| 1153/1154 | G71H; D74A | ++ | +++ |
| 1155/1156 | G71L; D74M | + | + |
| 1157/1158 | G71T | ++ | ++ |

[1] The percent conversion for each variant was determined relative to the reference polypeptide of SEQ ID NO: 1288 and defined as follows: "+" = greater than 1-fold but less than 2.0-fold increased activity; "++" = greater than 2.0-fold but less than 3-fold increased activity; "+++" = greater than 3-fold increased activity but less than 4-fold; "++++" = greater than 4-fold but less than 5-fold; "+++++" = greater than 5-fold but less than 6-fold; "++++++" = greater than 6-fold.
[2] The percent selectivities for each variant we determined relative to the reference polypeptide of SEQ ID NO: 1288 and defined as follows: "+" = greater than 1-fold but less than 2.0-fold increased selectivity; "++" = greater than 2.0-fold but less than 3-fold increased selectivity; "+++" = greater than 3-fold increased selectivity but less than 4-fold increase selectivity; "++++" = greater than 4-fold but less than 5-fold increase selectivity; "+++++" = greater than 5-fold but less than 6-fold increased selectivity; "++++++" = greater than 6-fold selectivity.

Example 9

Improvements Over SEQ ID NO: 1036 in the Deacylation of Tri-Protected Insulin at the A1 Position SEQ ID NO: 1036 was selected as the parent enzyme after screening variants described in Example 8. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3.

Each variant was screened in a 200 μL reaction that comprised of 5 g/L A1/B1/B29 tri-phenyl acetate insulin, 200 mM Tris buffer pH=8.0 and 10 μL soluble lysate for 5 hours at 30° C. The 96-well plates were heat-sealed and incubated in a Thermotron® shaker at 100 rpm. The reactions were quenched with 200 μl acetonitrile or dimethylacetamide and mixed for 5 minutes using a bench top shaker. The plates were then centrifuged at 4000 rpm for 5 minutes, diluted 2-fold into water, and loaded into an HPLC for analysis.

Percent conversion relative to SEQ ID NO:1036 (Percent Conversion FIOP) was calculated as the percent conversion of the product formed by the variant over the percent conversion produced by SEQ ID NO: 1036 and shown in Table 9.1. The percent conversion was quantified by dividing the area of the product peak by the sum of the areas of the substrate, product and impurities/side product peaks as observed by the HPLC analysis.

Percent selectivity relative to SEQ ID NO:1036 (Percent Selectivity FIOP) was calculated as the percent selectivity of the product formed by the variant over the percent selectivity produced by SEQ ID NO: 1036 and shown in Table 9.1. The percent selectivity was quantified by dividing the area of the product peak by the sum of the areas of the product and impurities/side product peaks as observed by the HPLC analysis.

TABLE 9.1

Deacylation Results

| SEQ ID NO: (nt/aa) | Amino Acid Differences (Relative to SEQ ID NO: 1036) | Deacylation Percent Conversion FIOP [1] | Deacylation Percent Selectivity FIOP [2] |
|---|---|---|---|
| 1175/1176 | A467L | + | + |
| 1171/1172 | T384Y | + | + |
| 1177/1178 | A255Y | + | + |
| 1165/1166 | D623E | + | + |
| 1169/1170 | L253M | + | + |
| 1183/1184 | T176C | + | + |
| 1163/1164 | A255S | + | + |
| 1181/1182 | T384R | +++ | + |
| 1159/1160 | T384K | + | + |
| 1185/1186 | L536T | + | + |
| 1189/1190 | L536K | + | + |
| 1193/1194 | N2L | +++ | + |
| 1179/1180 | F460Y | + | + |
| 1167/1168 | A255H | + | + |
| 1187/1188 | N47R | ++ | + |
| 1161/1162 | L253N | +++ | + |
| 1173/1174 | L253Q | + | + |
| 1191/1192 | L536R | + | + |

[1] The percent conversion was determined relative to the reference polypeptide of SEQ ID NO: 1036 and defined as follows: "+" = greater than 1-fold but less than 2.0-fold increased activity; "++" = greater than 2.0-fold but less than 2.5-fold increased activity; "+++" = greater than 2.5-fold increased activity.
[2] The percent selectivity was determined relative to the reference polypeptide of SEQ ID NO: 1036 and defined as follows: "+" = greater than 1-fold but less than 2.0-fold increased selectivity; "++" = greater than 2.0-fold but less than 2.5-fold increased selectivity; "+++" = greater than 2.5-fold increased selectivity.

Example 10

Improvements Over SEQ ID NO: 1194 in the Deacylation of Tri-Protected Insulin at the A1 Position SEQ ID NO: 1194 was selected as the parent enzyme after screening variants described in Example 9. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3.

Each variant was screened in a 200 μL reaction that comprised of 15 g/L A1/B1/B29 tri-phenyl acetate insulin, 200 mM Tris buffer pH=8.0 and 10 μL soluble lysate for 5 hours at 30° C. The 96-well plates were heat-sealed and incubated in a thermotron at 100 rpm. The reactions were quenched with 200 μl acetonitrile or dimethylacetamide and mixed for 5 minutes using a bench top shaker. The plates were then centrifuged at 4000 rpm for 5 minutes, diluted 2-fold into water, and loaded into an HPLC for analysis.

Percent conversion relative to SEQ ID NO: 1194 (Percent Conversion FIOP) was calculated as the percent conversion of the product formed by the variant over the percent conversion produced by SEQ ID NO: 1194 and shown in Table 10.1. The percent conversion was calculated by dividing the area of the product peak by the sum of the areas of the substrate, product and impurities/side product peaks as observed by the HPLC analysis.

Percent selectivity relative to SEQ ID NO: 1194 (Percent Selectivity FIOP) was calculated as the percent selectivity of the product formed by the variant over the percent selectivity produced by SEQ ID NO: 1194 and shown in Table 10.1. The percent selectivity was calculated by dividing the area of the product peak by the sum of the areas of the product and impurities/side product peaks as observed by the HPLC analysis.

TABLE 10.1

Deacylation Results

| SEQ ID NO: (nt/aa) | Amino Acid Differences (Relative to SEQ ID NO: 1194) | Deacylation Percent Conversion FIOP [1] | Deacylation Percent Selectivity FIOP [2] |
|---|---|---|---|
| 1195/1196 | V264A; T384K; A467L; D484N; L536T; Q547K | + | + |
| 1197/1198 | V264A; T384R; A467L; D484N; L536T; Q547K | + | + |
| 1199/1200 | T384K; A467L; D484N; L536T; Q547K | +++ | + |
| 1201/1202 | V264A; T384R; A467L; D484N; L536T; Q547K | + | + |
| 1203/1204 | V264A; T384R; A467L; D484N; L536T; Q547K | + | + |
| 1205/1206 | V264A; T384R; A467L; D484N; L536T; Q547K | + | + |
| 1207/1208 | T384R; A467L; D484N; L536T; Q547K | +++ | + |
| 1209/1210 | V264A; T384R; A467L; D484N; L536T; Q547K | + | + |
| 1211/1212 | A28T; V264A; T384R; A467L; D484N; L536T; Q547K | ++ | + |
| 1213/1214 | Q12A; K103E; W119Y; Q233K; T384R; G444N; N494D; S646D | ++ | |
| 1215/1216 | Q12A; K103E; T131A; Q233K; G444N; N494D; S646D | + | + |
| 1217/1218 | Q12A; K103E; W119Y; T131A; Q233K; G444N; N494D; S646D | + | + |
| 1219/1220 | Q12A; K103E; T131A; Q233K; G444N; A467L; N494D; S646D | ++ | + |
| 1221/1222 | Q12A; K103E; W119Y; Q233K; G444N; N494D; S646D | + | + |
| 1223/1224 | K103E; Q233K; G444N; N494D; S646D | + | + |

TABLE 10.1-continued

Deacylation Results

| SEQ ID NO: (nt/aa) | Amino Acid Differences (Relative to SEQ ID NO: 1194) | Deacylation Percent Conversion FIOP [1] | Deacylation Percent Selectivity FIOP [2] |
|---|---|---|---|
| 1225/1226 | Q12A; K103E; Q233K; G444N; N494D; S646D | + | |
| 1227/1228 | Q12A; K103E; W119Y; Q233K; G444N; N494D; S646D | + | + |
| 1229/1230 | K103E; W119Y; Q233K; G444N; N494D; S646D | + | + |
| 1231/1232 | Q12A; K103E; W119Y; T131A; Q233K; T384K; G444N; N494D; S646D | ++ | |
| 1233/1234 | Q12A; K103E; W119Y; Q233K; G444N; N494D; S646D | + | + |
| 1235/1236 | Q12A; K103E; W119Y; T131A; Q233K; G444N; N494D; S646D | + | + |
| 1237/1238 | Q12A; K103E; W119Y; T131A; Q233K; T384K; G444N; N494D; S646D | ++ | |
| 1239/1240 | Q12A; K103E; W119Y; T131A; Q233K; G444N; N494D; S646D | + | + |
| 1241/1242 | Q12A; K103E; W119Y; T131A; Q233K; G444N; N494D; S646D | + | + |
| 1243/1244 | Q12A; K103E; W119Y; Q233K; G444N; A467L; N494D; S646D | + | + |
| 1245/1246 | Q12A; K103E; W119Y; Q233K; G444N; A467L; N494D; S646D | + | + |
| 1247/1248 | Q12A; K103E; W119Y; Q233K; G444N; N494D; L536T; S646D | + | + |
| 1249/1250 | K103E; W119Y; T131A; Q233K; T384R; G444N; N494D; S646D | ++ | |
| 1251/1252 | Q12A; W119Y; Q233K; T384R; G444N; N494D; S646D | + | + |
| 1253/1254 | K668E | + | + |

[1] The percent conversion was determined relative to the reference polypeptide of SEQ ID NO: 1194 and defined as follows: "+" = greater than 1-fold but less than 2.0-fold increased activity; "++" = greater than 2.0-fold but less than 2.5-fold increased activity; "+++" = greater than 2.5-fold increased activity.
[2] The percent selectivity was determined relative to the reference polypeptide of SEQ ID NO: 1194 and defined as follows: "+" = greater than 1-fold but less than 2.0-fold increased selectivity; "++" = greater than 2.0-fold but less than 2.5-fold increased selectivity; "+++" = greater than 2.5-fold increased selectivity.

Example 11

Improvement in the Acylation of Insulin at A1, B1 and B29 Positions

A selection of variants in the Codex® Acylase Panel (Codexis) and disclosed in U.S. Prov. Pat. Appln. Ser. No. 62/158,118, were screened for their ability to acylate insulin at the A1, B1, and B29 positions. The polypeptides encoded by each gene were produced in HTP as described in Example 2 and the soluble lysate was generated as described in Example 3.

Each variant was screened in a 200 µL reaction that comprised of 10 g/L insulin, 0.1 M CHES buffer pH=10, 17 g/L methyl phenylacetate and 20 µL soluble lysate for 20 hours at 30° C. The 96-well plates were heat-sealed and incubated in a Thermothron® shaker at 300 rpm. The reactions were quenched with 200 µl acetonitrile and mixed for 5 minutes using a bench top shaker. The plates were then centrifuged at 4000 rpm for 5 minutes and loaded into an HPLC for analysis.

Percent conversion (% conv.) was calculated by dividing the area of the product peak by the sum of the areas of the substrate, product and impurities/side product peaks as observed by the HPLC analysis. Percent selectivity (% sel.) was calculated by dividing the area of the product peak by the sum of the areas of the product and impurities/side product peaks as observed by the HPLC analysis. The results are provided in FIG. 2.

Example 12

Improvement in the Acylation of Insulin at A1, B1 and B29 Positions Compared to SEQ ID NO:1288

SEQ ID NO: 1288 was selected as the parent enzyme after screening variants described in Example 11 and identifying the best enzyme at acylating insulin at position B29. Libraries of engineered genes were produced using well established techniques (e.g., saturation mutagenesis, recombination of previously identified beneficial mutations). The polypeptides encoded by each gene were produced in HTP as described in Example 2 and the soluble lysate was generated as described in Example 3.

Each variant was screened in a 200 µL reaction that comprised of 10 g/L insulin, 0.1 M TRIS buffer pH=9.25, 20% acetonitrile, 17 g/L methyl phenylacetate and 10 µL clarified lysate for 5 hours at 30° C. The 96-well plates were heat-sealed and incubated in a Thermotron® shaker at 100 rpm. The reactions were quenched with 200 µl acetonitrile and mixed for 5 minutes using a bench top shaker. The plates were then centrifuged at 4000 rpm for 5 minutes and loaded into an HPLC for analysis.

Percent conversion relative to SEQ ID NO:1288 (Percent Conversion FIOP) was calculated as the percent conversion of the product formed by the variant over the percent conversion produced by SEQ ID NO: 1288 and shown in Tables 12.1, 12.2, 12.3, 12.4, 12.5, 12.6, and 12.7. The percent conversion was calculated by dividing the area of the product peak by the sum of the areas of the substrate, product and impurities/side product peaks as observed by the HPLC analysis.

Percent selectivity relative to SEQ ID NO:1288 (Percent Selectivity FIOP) was calculated as the percent selectivity of the product formed by the variant over the percent selectivity produced by SEQ ID NO: 1288 and shown in Tables 12.1, 12.2, 12.3, 12.4, 12.5, 12.6, and 12.7. The percent selectivity was calculated by dividing the area of the product peak by the sum of the areas of the product and impurities/side product peaks as observed by the HPLC analysis.

TABLE 12.1

Acylation Results

| SEQ ID NO: (nt/aa) | Amino Acid Differences (Relative to SEQ ID NO: 1288) | A1 Acylation Percent Conversion (FIOP)[1] | A1 Acylation Percent Selectivity (FIOP)[2] |
|---|---|---|---|
| 1677/1678 | Y27T; F254W; A470V | ++ | + |
| 1679/1680 | Y27T; L253V; A255G; N348R | + | + |
| 1685/1686 | Y27T; A255G; W370I | +++ | |
| 1701/1702 | Y27T; D74S; F254W; A255G; N348R; K369C; T384P | + | + |

TABLE 12.1-continued

Acylation Results

| SEQ ID NO: (nt/aa) | Amino Acid Differences (Relative to SEQ ID NO: 1288) | A1 Acylation Percent Conversion (FIOP)[1] | A1 Acylation Percent Selectivity (FIOP)[2] |
|---|---|---|---|
| 1703/1704 | Y27T; D74N; L253V; F254W; N348R; K369C; T384P | ++ | + |
| 1759/1760 | L253M | + | + |
| 1797/1798 | T384R | ++ | + |
| 1799/1800 | D623N | + |  |
| 1811/1812 | L253S | + | + |
| 1817/1818 | N457T | + | + |
| 1819/1820 | R317S; Q380P | + | + |
| 1821/1822 | A373Y | + | + |
| 1859/1860 | K128W | + | + |
| 1901/1902 | T705S | + | + |

[1] The percent conversion was determined relative to the reference polypeptide of SEQ ID NO: 1288 and defined as follows: "+" = greater than 1-fold but less than 1.5-fold increased activity; "++" = greater than 1.5-fold but less than 2.0-fold increased activity; "+++" = greater than 2.0-fold increased activity.
[2] The percent selectivity was determined relative to the reference polypeptide of SEQ ID NO: 1288 and defined as follows: "+" = greater than 0.95-fold increase in selectivity.

TABLE 12.2

Acylation Results

| SEQ ID NO: (nt/aa) | Amino Acid Differences (Relative to SEQ ID NO: 1288) | B29 Acylation Percent Conversion (FIOP)[1] | B29 Acylation Percent Selectivity (FIOP)[2] |
|---|---|---|---|
| 1371/1372 | Y27T; N348R; D381K | + | + |
| 1417/1418 | Y27T; D74S; A255G; N348R; K369C; D381K |  | + |
| 1605/1606 | Y27T; D74S; A255G; N348R; D381K; T384P | + | + |
| 1637/1638 | Y27T; N348R; K369C; W370I; D381K; T384P |  | + |
| 1659/1660 | Y27T; D74G; F254W; A255G; N348R; K369C; W370I; D381K |  | + |
| 1689/1690 | Y27T; F254W; A255G; N348R; W370I; D381K |  | + |
| 1707/1708 | Y27T; A255G; N348R; W370I; D381K; T384P |  | + |
| 1711/1712 | D381F | + | + |
| 1715/1716 | Q134M | + | + |
| 1717/1718 | D623W | ++ | + |
| 1719/1720 | L253R | + | + |
| 1721/1722 | N627M | + | + |
| 1723/1724 | N627R | + | + |
| 1725/1726 | D623N | ++ | + |
| 1729/1730 | K615V | + | + |
| 1731/1732 | D381L | + | + |
| 1733/1734 | D381R | + | ++ |
| 1735/1736 | A132G | + | + |
| 1737/1738 | A467S | + | + |
| 1741/1742 | F256Y | + | + |
| 1743/1744 | D623V | + | + |
| 1745/1746 | K615H |  | + |
| 1747/1748 | D623A | + | + |
| 1749/1750 | D381Q | + | + |
| 1753/1754 | K615C |  | + |
| 1755/1756 | T384R | + | + |
| 1761/1762 | F256H | + | + |
| 1773/1774 | T453C |  | + |
| 1775/1776 | D381V |  | + |
| 1777/1778 | D381K | + | + |
| 1779/1780 | D381F; Q672K |  | + |
| 1781/1782 | D623Y | + | + |
| 1785/1786 | D623R | +++ | ++ |
| 1787/1788 | D623F | + | + |
| 1789/1790 | D623K | +++ | ++ |
| 1793/1794 | D381I |  | + |
| 1823/1824 | A373K | +++ | ++ |
| 1825/1826 | S706K | + | ++ |
| 1829/1830 | N348K; A467T | + | + |
| 1831/1832 | D709G | + | + |
| 1833/1834 | D709A | + | + |
| 1835/1836 | F620R | + | + |
| 1837/1838 | D709N | + | ++ |
| 1841/1842 | D709H | + | + |
| 1843/1844 | E377A |  | + |
| 1845/1846 | F620K | + | + |
| 1847/1848 | S706R |  | + |
| 1849/1850 | D709R | + | ++++ |
| 1853/1854 | N20S; D709Q |  | + |
| 1857/1858 | D709S | + | + |
| 1867/1868 | V618C | + | + |
| 1871/1872 | A69M |  | + |
| 1875/1876 | F254K | + | + |
| 1877/1878 | A84V |  | + |
| 1879/1880 | F701H |  | + |
| 1881/1882 | P383K |  | + |
| 1883/1884 | A69L |  | +++ |
| 1885/1886 | I708V |  | + |
| 1889/1890 | A255K | ++ | ++ |
| 1893/1894 | A255R | ++ | ++ |
| 1895/1896 | A69V |  | + |
| 1897/1898 | P383R |  | ++++ |

[1] The percent conversion was determined relative to the reference polypeptide of SEQ ID NO: 1288 and defined as follows: "+" = greater than 2-fold but less than 4-fold increased activity; "++" = greater than 4-fold but less than 6-fold increased activity; "+++" = greater than 6-fold increased activity.
[2] The percent selectivity was determined relative to the reference polypeptide of SEQ ID NO: 1288 and defined as follows: "+" = greater than 2.0-fold but less than 5-fold increase in selectivity; "++" = greater than 5.0-fold but less than 10-fold increase in selectivity; "+++" = greater than 10.0-fold but less than 15-fold increase in selectivity; "++++" = greater than 15.0-fold in selectivity.

TABLE 12.3

Acylation Results

| SEQ ID NO: (nt/aa) | Amino Acid Differences (Relative to SEQ ID NO: 1288) | B1 Acylation Percent Conversion (FIOPC)[1] | B1 Acylation Percent Selectivity (FIOPC)[2] |
|---|---|---|---|
| 1315/1316 | Y27T; L253V | + |  |
| 1317/1318 | Y27T; D74G; L253V; F254W | ++ | + |
| 1323/1324 | Y27T; D74G; L253V; A255G; N348R; W370I; T384P | ++ | + |
| 1325/1326 | Y27T; D74N; L253V; F254W; N348R; W370I; D381K; T384P | ++ | ++ |
| 1327/1328 | Y27T; D74N; L253V; F254W; A255G; N348R; W370I | ++ | ++ |
| 1335/1336 | Y27T; D74G; L253V; N348R; K369C; W370I; D381F; T384P | + | + |
| 1337/1338 | Y27T; L253V; F254W; N348R | + |  |

TABLE 12.3-continued

Acylation Results

| SEQ ID NO: (nt/aa) | Amino Acid Differences (Relative to SEQ ID NO: 1288) | B1 Acylation Percent Conversion (FIOPC)[1] | B1 Acylation Percent Selectivity (FIOPC)[2] |
|---|---|---|---|
| 1339/1340 | Y27T; D74P; L253V; F254W; A255G; N348R | + | + |
| 1345/1346 | Y27T; D74G; L253V; F254W; A255G; W370I | ++ | ++ |
| 1347/1348 | Y27T; L253V; F254W; A255G | + | |
| 1349/1350 | Y27T; D74G; L253V; F254W; T384P | ++ | + |
| 1351/1352 | Y27T; D74N; F254W; N348R; W370I | + | + |
| 1353/1354 | Y27T; D74S; L253V; N348R; W370I; D381K; T384P | ++ | + |
| 1357/1358 | Y27T; L253V; A255G; W370I | + | + |
| 1359/1360 | Y27T; D74G; F254W; A255G; D381F | + | + |
| 1365/1366 | Y27T; L253V; K369C; W370I | + | |
| 1377/1378 | Y27T; L253V; F254W; N348R; D381F | + | + |
| 1379/1380 | Y27T; L253V; F254W; A255G; N348R; W370I | + | + |
| 1381/1382 | Y27T; D74S; L253V; A255G; T384P | + | + |
| 1387/1388 | Y27T; D74N; L253V; N348R; W370I; D381W; T384P | ++ | + |
| 1393/1394 | Y27T; D74P; L253V; N348R | + | + |
| 1399/1400 | Y27T; D74G; F254W; A255G; N348R; K369C; W370I; D381F | + | + |
| 1401/1402 | Y27T; D74P; F254W; A255G; N348R; K369C; W370I | + | + |
| 1403/1404 | Y27T; D74N; L253V; F254W; W370I; D381K | ++ | ++ |
| 1409/1410 | Y27T; D74G; L253V; T384P | + | + |
| 1411/1412 | Y27T; D74S; N348R; W370I | + | + |
| 1413/1414 | Y27T; D74S; L253V; F254W; A255G; K369C; W370I | + | + |
| 1419/1420 | Y27T; D74G; L253V; N348R; K369C; W370I | + | |
| 1425/1426 | Y27T; D74N; L253V; F254W; A255G | ++ | + |
| 1429/1430 | Y27T; D74P; L253V; F254W; N348R | + | + |
| 1435/1436 | Y27T; D74G; A255G; W370I | + | + |
| 1437/1438 | Y27T; D74G; A255G; N348R; D381W | + | + |
| 1439/1440 | Y27T; D74P; L253V; W370I | ++ | + |
| 1441/1442 | Y27T; L253V; N348R; W370I; T384P | + | |
| 1443/1444 | Y27T; D74G; L253V; F254W; A255G; W370I; D381K; T384P | ++ | + |
| 1447/1448 | Y27T; D74N; F254W; A255G; N348R; W370I; D381K | + | + |
| 1449/1450 | Y27T; D74S; L253V; N348R; K369C; W370I; T384P | + | + |
| 1453/1454 | Y27T; D74N; L253V; F254W; N348R; W370I; D381F | ++ | ++ |
| 1455/1456 | Y27T; D74S; F254W; A255G; N348R; W370I; D381F; T384P | + | + |
| 1457/1458 | Y27T; D74G; L253V; F254W; A255G; D381K | ++ | ++ |
| 1459/1460 | Y27T; D74S; F254W; K369L; W370I | + | + |
| 1463/1464 | Y27T; L253V; F254W; D381F; T384P | + | + |
| 1465/1466 | Y27T; D74G; L253V; F254W; A255G; K369C; W370I | + | |
| 1467/1468 | Y27T; D74G; F254W; A255G; N348R; W370I | ++ | + |
| 1469/1470 | Y27T; D74G; L253V; F254W; A255G; N348R; W370I; T384P | ++ | ++ |
| 1471/1472 | L253V; N348R; W370I | + | |
| 1475/1476 | Y27T; D74N; L253V; F254W; K369C | + | + |
| 1477/1478 | Y27T; D74G; F254W; A255G; N348R | + | |
| 1479/1480 | Y27T; D74S; L253V; N348R; D381W | + | + |
| 1481/1482 | Y27T; D74S; L253V; N348R | + | + |
| 1483/1484 | Y27T; L253V; F254W; A255G; N348R | + | |
| 1489/1490 | Y27T; D74S; L253V; A255G; N348R; W370I; D381K | ++ | ++ |
| 1491/1492 | Y27T; F254W; A255G; N348R; K369C; W370I | + | + |
| 1493/1494 | Y27T; D74N; L253V; F254W; A255G; N348R; W370I; T384P | ++ | +++ |
| 1495/1496 | Y27T; D74S; F254W; A255G; W370I | ++ | ++ |
| 1497/1498 | Y27T; F254W; A255G; K369C; W370I; D381F; T384P | + | |
| 1501/1502 | Y27T; L253V; F254W; D381F | ++ | + |
| 1503/1504 | Y27T; D74N; F254W; N348R | + | |
| 1505/1506 | Y27T; F254W; A255G; W370I | + | + |
| 1509/1510 | Y27T; D74N; A107V; A255G; N348R; K369C; W370I | + | |
| 1511/1512 | Y27T; F254W; A255G; N348R; W370I | + | |
| 1515/1516 | Y27T; D74N; F254W | + | + |
| 1521/1522 | Y27T; D74G; L253V; D381F; T384P | + | + |
| 1523/1524 | Y27T; D74P; L253V; A255G | + | + |
| 1525/1526 | Y27T; D74S; L253V; F254W; A255G; N348R | + | + |
| 1529/1530 | Y27T; D74S; F254W; A255G; N348R; K369C; W370I | + | |
| 1533/1534 | Y27T; D74P; W370I | + | |
| 1537/1538 | Y27T; L253V; F254W; T384P | + | + |
| 1543/1544 | Y27T; D74N; L253V; F254W; A255G; W370I | +++ | +++ |
| 1545/1546 | Y27T; D74G; L253V; N348R; W370I | ++ | + |
| 1553/1554 | Y27T; F254W; A255G; N348R; W370I; T384P | + | |
| 1555/1556 | Y27T; D74G; L253V; F254W; N348R | + | + |
| 1563/1564 | Y27T; L253V; A255G; W370I; D381F; T384P | + | |
| 1565/1566 | Y27T; L253V; A255G; N348R; D381K | + | + |
| 1567/1568 | Y27T; L253V; F254W; N348R; W370I; T384P | + | + |
| 1569/1570 | Y27T; D74N; F254W; N348R; W370I; D381K | + | + |
| 1571/1572 | Y27T; D74N; L253V; A255G; N348R; K369C; W370I | + | + |
| 1573/1574 | Y27T; L253V; F254W; N348R; D381W; T384P | + | + |
| 1577/1578 | Y27T; L253V; F254W; A255G; G260C; N348R; D381F; T384P | + | + |

TABLE 12.3-continued

Acylation Results

| SEQ ID NO: (nt/aa) | Amino Acid Differences (Relative to SEQ ID NO: 1288) | B1 Acylation Percent Conversion (FIOPC)[1] | B1 Acylation Percent Selectivity (FIOPC)[2] |
|---|---|---|---|
| 1579/1580 | Y27T; D74P; L253V; F254W; N348R; D381F; T384P | + | + |
| 1583/1584 | Y27T; D74G; L253V; N348R; K369C; W370I; D381F | + | + |
| 1585/1586 | Y27T; D74N; L253V; N348R | + | + |
| 1587/1588 | Y27T; D74G; L253V; A255G; N348R; T384P | + | + |
| 1589/1590 | Y27T; D74N; L253V; A255G; W370I | ++ | ++ |
| 1591/1592 | Y27T; D74N; A255G; N348R; W370I | + | + |
| 1593/1594 | Y27T; L253V; N348R; D381F; T384P | + | |
| 1603/1604 | Y27T; L253V; D381F; T384P | + | |
| 1607/1608 | Y27T; D74P; L253V; F254W; N348R; W370I; D381W; T384P | ++ | + |
| 1609/1610 | Y27T; L253V; F254W; A255G; N348R; W370I; T384P | + | |
| 1627/1628 | Y27T; L253V; F254W | + | + |
| 1631/1632 | Y27T; L253V; F254W; N348R; W370I; D381F | ++ | ++ |
| 1633/1634 | Y27T; D74G; L253V; A255G | + | + |
| 1635/1636 | Y27T; D74N; L253V; F254W; N348R; W370I | +++ | +++ |
| 1639/1640 | Y27T; D74N; L253V; F254W; N348R; K369C; W370I; D381K | + | + |
| 1643/1644 | Y27T; D74G; L253V; F254W; A255G; N348R; K369C; W370I; D381F | + | + |
| 1645/1646 | Y27T; D74G; L253V; F254W; N348R; K369C; W370I | + | + |
| 1655/1656 | Y27T; D74N; L253V | + | + |
| 1657/1658 | Y27T; D74G; L253V; F254W; A255G; N348R | + | + |
| 1661/1662 | Y27T; F254W; A255G; T384P | + | |
| 1663/1664 | Y27T; F254W; A255G | ++ | + |
| 1667/1668 | Y27T; L253V; F254W; A255G; N348R; D381F; T384P | + | + |
| 1669/1670 | Y27T; F254W; A255G; N348R | + | + |
| 1671/1672 | Y27T; D74N; F254W; T384P | + | |
| 1673/1674 | Y27T; L253V; N348R | + | + |
| 1675/1676 | Y27T; D74G; A255G; N348R | + | |
| 1677/1678 | Y27T; F254W; A470V | + | |
| 1679/1680 | Y27T; L253V; A255G; N348R | + | |
| 1681/1682 | Y27T; D74N; L253V; K369C; D381K; T384P | + | + |
| 1683/1684 | Y27T; D74G; L253V; A255G; N348R; D381F | ++ | + |
| 1685/1686 | Y27T; A255G; W370I | + | |
| 1687/1688 | Y27T; D74S; F254W; A255G; N348R | + | |
| 1693/1694 | Y27T; D74S; L253V; F254W; N348R; D381W; T384P | +++ | ++ |
| 1695/1696 | Y27T; D74N; F254W; A255G; N348R | + | |
| 1697/1698 | Y27T; D74P; L253V; F254W; A255G | ++ | + |
| 1705/1706 | Y27T; L253V; N348R; W370I; D381F; T384P | ++ | ++ |
| 1709/1710 | Y27T; D74S; A255G; W370I | + | |
| 1815/1816 | N388E | + | ++ |
| 1865/1866 | A255P | + | |

[1] The percent conversion was determined relative to the reference polypeptide of SEQ ID NO: 1288 and defined as follows: "+" = greater than 2-fold but less than 5-fold increased activity; "++" = greater than 5-fold but less than 10-fold increased activity; "+++" = greater than 10-fold increased activity.
[2] The percent selectivity was determined relative to the reference polypeptide of SEQ ID NO: 1288 and defined as follows: "+" = greater than 2.0-fold but less than 5-fold increase in selectivity; "++" = greater than 5.0-fold but less than 7-fold increase in selectivity; "+++" = greater than 7.0-fold in selectivity.

TABLE 12.4

Acylation Results

| SEQ ID NO: (nt/aa) | Amino Acid Differences (Relative to SEQ ID NO: 1288) | A1/B29 Acylation Percent Conversion (FIOPC)[1] | A1/B29 Acylation Percent Selectivity (FIOPC)[2] |
|---|---|---|---|
| 1319/1320 | Y27T; D74S; F254W; N348R; D381W | + | + |
| 1329/1330 | Y27T; A255G; N348R; W370I | + | |
| 1333/1334 | Y27T; N348R; T384P | + | + |
| 1363/1364 | Y27T; D74G; F254W; A255G; N348R; D381W | + | + |
| 1373/1374 | Y27T; D74S; N348R | + | |
| 1499/1500 | Y27T; A255G; N348R | + | + |
| 1507/1508 | Y27T; L253V; N348R; D381F; T384P | + | + |
| 1541/1542 | Y27T; L253V; F254W; N348R; T384P | + | |
| 1551/1552 | Y27T; D74P; F254W; A255G; N348R; D381K; T384P | + | + |
| 1595/1596 | Y27T; N348R | + | + |
| 1599/1600 | Y27T; F254W; A255G; N348R; W370I; D381W; T384P | + | |
| 1605/1606 | Y27T; D74S; A255G; N348R; D381K; T384P | + | + |
| 1613/1614 | Y27T; D74G; F254W; N348R; D381W; T384P | + | + |
| 1615/1616 | Y27T; F254W; A255G; D381K; T384P | + | + |
| 1621/1622 | Y27T; D74S; F254W; N348R; D381F | + | + |
| 1647/1648 | Y27T; A255G; N348R; D381W; T384P | + | + |
| 1651/1652 | Y27T; F254W; N348R; D381W; T384P | + | + |
| 1653/1654 | Y27T; D74G; N348R | + | + |

TABLE 12.4-continued

Acylation Results

| SEQ ID NO: (nt/aa) | Amino Acid Differences (Relative to SEQ ID NO: 1288) | A1/B29 Acylation Percent Conversion (FIOPC)[1] | A1/B29 Acylation Percent Selectivity (FIOPC)[2] |
|---|---|---|---|
| 1661/1662 | Y27T; F254W; A255G; T384P | ++ | + |
| 1663/1664 | Y27T; F254W; A255G | ++ | + |
| 1665/1666 | Y27T; D74S; L253V; N348R | +++ | ++ |
| 1667/1668 | Y27T; L253V; F254W; A255G; N348R; D381F; T384P | + | + |
| 1669/1670 | Y27T; F254W; A255G; N348R | + | + |
| 1671/1672 | Y27T; D74N; F254W; T384P | +++ | + |
| 1673/1674 | Y27T; L253V; N348R | + | + |
| 1675/1676 | Y27T; D74G; A255G; N348R | ++ | ++ |
| 1677/1678 | Y27T; F254W; A470V | + | |
| 1679/1680 | Y27T; L253V; A255G; N348R | + | + |
| 1683/1684 | Y27T; D74G; L253V; A255G; N348R; D381F | ++ | + |
| 1685/1686 | Y27T; A255G; W370I | ++ | + |
| 1687/1688 | Y27T; D74S; F254W; A255G; N348R | +++ | ++ |
| 1691/1692 | Y27T; D74N; L253V; F254W | + | |
| 1693/1694 | Y27T; D74S; L253V; F254W; N348R; D381W; T384P | ++ | ++ |
| 1695/1696 | Y27T; D74N; F254W; A255G; N348R | +++ | ++ |
| 1699/1700 | Y27T; D74G; L253V; F254W; A255G; N348R | +++ | + |
| 1705/1706 | Y27T; L253V; N348R; W370I; D381F; T384P | + | + |
| 1707/1708 | Y27T; A255G; N348R; W370I; D381K; T384P | + | + |
| 1709/1710 | Y27T; D74S; A255G; W370I | ++ | + |
| 1717/1718 | D623W | + | + |
| 1719/1720 | L253R | + | + |
| 1747/1748 | D623A | + | + |
| 1757/1758 | D623N | + | + |
| 1761/1762 | F256H | + | |
| 1763/1764 | A616R | + | |
| 1771/1772 | D623L | + | + |
| 1781/1782 | D623Y | + | + |
| 1787/1788 | D623F | + | + |
| 1789/1790 | D623K | + | + |
| 1803/1804 | D381Q | + | + |
| 1805/1806 | T384R | ++ | ++ |
| 1813/1814 | D623R | ++ | +++ |
| 1823/1824 | A373K | + | ++ |
| 1851/1852 | H472R | + | |
| 1855/1856 | F620R | + | + |
| 1865/1866 | A255P | + | |
| 1875/1876 | F254K | + | + |
| 1893/1894 | A255R | + | + |

[1] The percent conversion was determined relative to the reference polypeptide of SEQ ID NO: 1288 and defined as follows: "+" = greater than 2-fold but less than 5-fold increased activity; "++" = greater than 5-fold but less than 10-fold increased activity; "+++" = greater than 10-fold increased activity.
[2] The percent selectivity was determined relative to the reference polypeptide of SEQ ID NO: 1288 and defined as follows: "+" = greater than 2.0-fold but less than 5-fold increase in selectivity; "++" = greater than 5.0-fold but less than 7-fold increase in selectivity; "+++" = greater than 7.0-fold in selectivity.

TABLE 12.5

Acylation Results

| SEQ ID NO: (nt/aa) | Amino Acid Differences (Relative to SEQ ID NO: 1288) | A1/B1 Acylation Percent Conversion (FIOPC)[1] | A1/B1 Acylation Percent Selectivity (FIOPC)[2] |
|---|---|---|---|
| 1313/1314 | Y27T; L253V; A255G; N348R; T384P | + | + |
| 1315/1316 | Y27T; L253V | + | + |
| 1317/1318 | Y27T; D74G; L253V; F254W | + | + |
| 1323/1324 | Y27T; D74G; L253V; A255G; N348R; W370I; T384P | + | + |
| 1325/1326 | Y27T; D74N; L253V; F254W; N348R; W370I; D381K; T384P | + | + |
| 1327/1328 | Y27T; D74N; L253V; F254W; A255G; N348R; W370I | + | + |
| 1329/1330 | Y27T; A255G; N348R; W370I | + | + |
| 1331/1332 | Y27T; D74P; L253V; F254W; A255G; N348R; K369C; W370I | + | + |
| 1335/1336 | Y27T; D74G; L253V; N348R; K369C; W370I; D381F; T384P | + | + |
| 1337/1338 | Y27T; L253V; F254W; N348R | + | + |
| 1339/1340 | Y27T; D74P; L253V; F254W; A255G; N348R | + | + |
| 1341/1342 | Y27T | + | |
| 1343/1344 | Y27T; D74G; L253V; N348R; K369C; W370I | + | + |
| 1345/1346 | Y27T; D74G; L253V; F254W; A255G; W370I | ++ | + |
| 1347/1348 | Y27T; L253V; F254W; A255G | + | + |
| 1349/1350 | Y27T; D74G; L253V; F254W; T384P | + | + |
| 1351/1352 | Y27T; D74N; F254W; N348R; W370I | + | + |
| 1353/1354 | Y27T; D74S; L253V; N348R; W370I; D381K; T384P | + | + |
| 1357/1358 | Y27T; L253V; A255G; W370I | + | + |
| 1359/1360 | Y27T; D74G; F254W; A255G; D381F | + | + |
| 1365/1366 | Y27T; L253V; K369C; W370I | + | + |
| 1375/1376 | Y27T; D74P; F254W; A255G; N348R | + | + |
| 1377/1378 | Y27T; L253V; F254W; N348R; D381F | + | + |
| 1381/1382 | Y27T; D74S; L253V; A255G; T384P | + | + |
| 1383/1384 | Y27T; D74G; A255G; W370I | + | + |
| 1385/1386 | Y27T; D74S; N348R | + | |
| 1387/1388 | Y27T; D74N; L253V; N348R; W370I; D381W; T384P | + | + |

TABLE 12.5-continued

Acylation Results

| SEQ ID NO: (nt/aa) | Amino Acid Differences (Relative to SEQ ID NO: 1288) | A1/B1 Acylation Percent Conversion (FIOPC)[1] | A1/B1 Acylation Percent Selectivity (FIOPC)[2] |
|---|---|---|---|
| 1389/1390 | Y27T; D74G; L253V; F254W; N348R | + | + |
| 1393/1394 | Y27T; D74P; L253V; N348R | + | + |
| 1395/1396 | Y27T; L253V; F254W; A255G; N348R | + | + |
| 1397/1398 | Y27T; D74S; L253V; F254W; A255G; N348R | + | + |
| 1399/1400 | Y27T; D74G; F254W; A255G; N348R; K369C; W370I; D381F | + | + |
| 1401/1402 | Y27T; D74P; F254W; A255G; N348R; K369C; W370I | + | + |
| 1403/1404 | Y27T; D74N; L253V; F254W; W370I; D381K | ++ | + |
| 1405/1406 | Y27T; D74G; F254W; K369C; W370I | + | + |
| 1407/1408 | Y27T; D74G; L253V; N348R; W370I | + | + |
| 1409/1410 | Y27T; D74G; L253V; T384P | + | + |
| 1411/1412 | Y27T; D74S; N348R; W370I | + | + |
| 1413/1414 | Y27T; D74S; L253V; F254W; A255G; K369C; W370I | + | + |
| 1421/1422 | Y27T; D74G; F254W; A255G; N348R | + | + |
| 1423/1424 | Y27T; L253V; N348R; W370I; T384P | + | + |
| 1425/1426 | Y27T; D74N; L253V; F254W; A255G | + | + |
| 1427/1428 | Y27T; L253V; F254W | + | + |
| 1431/1432 | Y27T; D74G; K369C; W370I | + | + |
| 1433/1434 | Y27T; F254W; A449V | + | + |
| 1437/1438 | Y27T; D74G; L253V; A255G; N348R; D381W | + | + |
| 1439/1440 | Y27T; D74P; L253V; W370I | + | + |
| 1443/1444 | Y27T; D74G; L253V; F254W; A255G; W370I; D381K; T384P | ++ | + |
| 1447/1448 | Y27T; D74N; F254W; A255G; N348R; W370I; D381K | + | + |
| 1449/1450 | Y27T; D74S; L253V; N348R; K369C; W370I; T384P | + | + |
| 1451/1452 | Y27T; D74N; L253V; N348R | + | + |
| 1453/1454 | Y27T; D74N; L253V; F254W; N348R; W370I; D381F | + | + |
| 1455/1456 | Y27T; D74S; F254W; A255G; N348R; W370I; D381F; T384P | + | + |
| 1457/1458 | Y27T; D74G; L253V; F254W; A255G; D381K | + | + |
| 1459/1460 | Y27T; D74S; F254W; K369L; W370I | + | + |
| 1463/1464 | Y27T; L253V; F254W; D381F; T384P | + | + |
| 1465/1466 | Y27T; D74G; L253V; F254W; A255G; K369C; W370I | + | + |
| 1467/1468 | Y27T; D74G; F254W; A255G; N348R; W370I | + | + |
| 1469/1470 | Y27T; D74G; L253V; F254W; A255G; N348R; W370I; T384P | + | + |
| 1471/1472 | L253V; N348R; W370I | + | + |
| 1473/1474 | Y27T; F254W; N348R; W370I | + | + |
| 1475/1476 | Y27T; D74N; L253V; F254W; K369C | + | + |
| 1479/1480 | Y27T; D74S; L253V; N348R; D381W | + | + |
| 1485/1486 | Y27T; D74S; A255G | + | + |
| 1489/1490 | Y27T; D74S; L253V; A255G; N348R; W370I; D381K | + | + |
| 1493/1494 | Y27T; D74N; L253V; F254W; A255G; N348R; W370I; T384P | + | + |
| 1495/1496 | Y27T; D74S; F254W; A255G; W370I | ++ | + |
| 1497/1498 | Y27T; F254W; A255G; K369C; W370I; D381F; T384P | + | + |
| 1501/1502 | Y27T; L253V; F254W; D381F | + | + |
| 1503/1504 | Y27T; D74N; F254W; N348R | + | + |
| 1505/1506 | Y27T; F254W; A255G; W370I | ++ | + |
| 1509/1510 | Y27T; D74N; A107V; A255G; N348R; K369C; W370I | + | + |
| 1511/1512 | Y27T; F254W; A255G; N348R; W370I | + | + |
| 1515/1516 | Y27T; D74N; F254W | + | + |
| 1517/1518 | Y27T; D74S; F254W; K369C; T384P | + | + |
| 1521/1522 | Y27T; D74G; L253V; D381F; T384P | + | + |
| 1523/1524 | Y27T; D74P; L253V; A255G | + | + |
| 1527/1528 | Y27T; D74G; A255G; N348R; K369C; W370I | + | + |
| 1529/1530 | Y27T; D74S; F254W; A255G; N348R; K369C; W370I | + | + |
| 1531/1532 | Y27T; F254W; A255G; N348R; K369C; W370I | + | + |
| 1533/1534 | Y27T; D74P; W370I | + | + |
| 1535/1536 | Y27T; D74P; L253V; F254W; N348R; K369C; W370I | + | + |
| 1537/1538 | Y27T; L253V; F254W; T384P | + | + |

TABLE 12.5-continued

Acylation Results

| SEQ ID NO: (nt/aa) | Amino Acid Differences (Relative to SEQ ID NO: 1288) | A1/B1 Acylation Percent Conversion (FIOPC)[1] | A1/B1 Acylation Percent Selectivity (FIOPC)[2] |
|---|---|---|---|
| 1541/1542 | Y27T; L253V; F254W; N348R; T384P | + | + |
| 1543/1544 | Y27T; D74N; L253V; F254W; A255G; W370I | + | + |
| 1547/1548 | Y27T; F254W; A255G; N348R | + | + |
| 1549/1550 | Y27T; D74S; F254W; N348R | + | + |
| 1553/1554 | Y27T; F254W; A255G; N348R; W370I; T384P | + | + |
| 1557/1558 | D74N; F254W; K369C; W370I | + | + |
| 1561/1562 | Y27T; D74S; K369C; W370I; D381K; T384P | + | + |
| 1563/1564 | Y27T; L253V; A255G; W370I; D381F; T384P | ++ | + |
| 1567/1568 | Y27T; L253V; F254W; N348R; W370I; T384P | + | + |
| 1569/1570 | Y27T; D74N; F254W; N348R; W370I; D381K | + | + |
| 1571/1572 | Y27T; D74N; L253V; A255G; N348R; K369C; W370I | + | + |
| 1573/1574 | Y27T; L253V; F254W; N348R; D381W; T384P | + | + |
| 1577/1578 | Y27T; L253V; F254W; A255G; G260C; N348R; D381F; T384P | + | |
| 1579/1580 | Y27T; D74P; L253V; F254W; N348R; D381F; T384P | + | + |
| 1587/1588 | Y27T; D74G; L253V; A255G; N348R; T384P | + | + |
| 1589/1590 | Y27T; D74N; L253V; A255G; W370I | + | + |
| 1591/1592 | Y27T; D74N; A255G; N348R; W370I | + | + |
| 1599/1600 | Y27T; F254W; A255G; N348R; W370I; D381W; T384P | + | + |
| 1601/1602 | Y27T; L253V; A255G; N348R; K369C; W370I | + | + |
| 1603/1604 | Y27T; L253V; D381F; T384P | + | + |
| 1607/1608 | Y27T; D74P; L253V; F254W; N348R; W370I; D381W; T384P | + | + |
| 1609/1610 | Y27T; L253V; F254W; A255G; N348R; W370I; T384P | + | + |
| 1611/1612 | A255G; N348R; W370I | + | + |
| 1613/1614 | Y27T; D74G; F254W; N348R; D381W; T384P | + | |
| 1615/1616 | Y27T; F254W; A255G; D381K; T384P | + | + |
| 1623/1624 | Y27T; D74N; F254W; A255G; K369C | + | + |
| 1625/1626 | Y27T; D74P; L253V; F254W; N348R | + | + |
| 1631/1632 | Y27T; L253V; F254W; N348R; W370I; D381F | + | + |
| 1633/1634 | Y27T; D74G; L253V; A255G | + | + |
| 1635/1636 | Y27T; D74N; L253V; F254W; N348R; W370I | + | + |
| 1643/1644 | Y27T; D74G; L253V; F254W; A255G; N348R; K369C; W370I; D381F | + | + |
| 1645/1646 | Y27T; D74G; L253V; F254W; N348R; K369C; W370I | + | + |
| 1649/1650 | Y27T; L253V; F254W; A255G; N348R; W370I | ++ | + |
| 1655/1656 | Y27T; D74N; L253V | + | + |
| 1661/1662 | Y27T; F254W; A255G; T384P | ++ | ++ |
| 1663/1664 | Y27T; F254W; A255G | ++ | ++ |
| 1665/1666 | Y27T; D74S; L253V; N348R | ++ | ++ |
| 1667/1668 | Y27T; L253V; F254W; A255G; N348R; D381F; T384P | + | + |
| 1671/1672 | Y27T; D74N; F254W; T384P | +++ | ++ |
| 1673/1674 | Y27T; L253V; N348R | + | + |
| 1675/1676 | Y27T; D74G; A255G; N348R | + | + |
| 1677/1678 | Y27T; F254W; A470V | + | + |
| 1679/1680 | Y27T; L253V; A255G; N348R | + | + |
| 1683/1684 | Y27T; D74G; L253V; A255G; N348R; D381F | + | + |
| 1685/1686 | Y27T; A255G; W370I | ++ | ++ |
| 1687/1688 | Y27T; D74S; F254W; A255G; N348R | ++ | + |
| 1691/1692 | Y27T; D74N; L253V; F254W | ++++ | ++ |
| 1693/1694 | Y27T; D74S; L253V; F254W; N348R; D381W; T384P | ++ | ++ |
| 1695/1696 | Y27T; D74N; F254W; A255G; N348R | ++ | + |
| 1697/1698 | Y27T; D74P; L253V; F254W; A255G | +++ | ++ |
| 1699/1700 | Y27T; D74G; L253V; F254W; A255G; N348R | ++ | ++ |
| 1701/1702 | Y27T; D74S; F254W; A255G; N348R; K369C; T384P | + | |
| 1703/1704 | Y27T; D74N; L253V; F254W; N348R; K369C; T384P | + | + |
| 1705/1706 | Y27T; L253V; N348R; W370I; D381F; T384P | + | + |
| 1709/1710 | Y27T; D74S; A255G; W370I | +++ | ++ |
| 1711/1712 | D381F | + | + |
| 1713/1714 | A132S | + | + |

TABLE 12.5-continued

Acylation Results

| SEQ ID NO: (nt/aa) | Amino Acid Differences (Relative to SEQ ID NO: 1288) | A1/B1 Acylation Percent Conversion (FIOPC)[1] | A1/B1 Acylation Percent Selectivity (FIOPC)[2] |
|---|---|---|---|
| 1715/1716 | Q134M | + | + |
| 1717/1718 | D623W | + | + |
| 1727/1728 | T131L | + | + |
| 1731/1732 | D381L | + | + |
| 1735/1736 | A132G | + | + |
| 1751/1752 | W370V | + | + |
| 1765/1766 | D381R | + | + |
| 1769/1770 | T384R | + | + |
| 1791/1792 | D623Y | + | + |
| 1799/1800 | D623N | + | + |
| 1801/1802 | D623R | + | + |
| 1807/1808 | S619I | + | |
| 1809/1810 | L253V | + | + |
| 1839/1840 | T133K | + | |
| 1865/1866 | A255P | + | + |
| 1887/1888 | I708M | + | |
| 1891/1892 | F254T | + | + |
| 1899/1900 | T705S | + | |

[1]The percent conversion was determined relative to the reference polypeptide of SEQ ID NO: 1288 and defined as follows: "+" = greater than 2-fold but less than 10-fold increased activity; "++" = greater than 10-fold but less than 50-fold increased activity; "+++" = greater than 50-fold but less than 100-fold increased activity; "++++" = greater than 100-fold increase activity.
[2]The percent selectivity was determined relative to the reference polypeptide of SEQ ID NO: 1288 and defined as follows: "+" = greater than 2-fold but less than 10-fold increased selectivity; "++" = greater than 10-fold but less than 50-fold increased selectivity; "+++" = greater than 50-fold but less than 100-fold increased selectivity; "++++" = greater than 100-fold increase selectivity.

TABLE 12.6

Acylation Results

| SEQ ID NO: (nt/aa) | Amino Acid Differences (Relative to SEQ ID NO: 1288) | B1/B29 Acylation Percent Conversion (FIOPC)[1] | B1/B29 Acylation Percent Selectivity (FIOPC)[2] |
|---|---|---|---|
| 1323/1324 | Y27T; D74G; L253V; A255G; N348R; W370I; T384P | + | + |
| 1325/1326 | Y27T; D74N; L253V; F254W; N348R; W370I; D381K; T384P | + | + |
| 1327/1328 | Y27T; D74N; L253V; F254W; A255G; N348R; W370I | + | + |
| 1345/1346 | Y27T; D74G; L253V; F254W; A255G; W370I | + | |
| 1349/1350 | Y27T; D74G; L253V; F254W; T384P | + | |
| 1353/1354 | Y27T; D74S; L253V; N348R; W370I; D381K; T384P | + | + |
| 1387/1388 | Y27T; D74N; L253V; N348R; W370I; D381W; T384P | ++ | + |
| 1389/1390 | Y27T; D74G; L253V; F254W; N348R | + | |
| 1391/1392 | Y27T; L253V; F254W; A255G; N348R; K369C; W370I; D381W; T384P | + | + |
| 1397/1398 | Y27T; D74S; L253V; F254W; A255G; N348R | + | + |
| 1403/1404 | Y27T; D74N; L253V; F254W; W370I; D381K | + | + |
| 1411/1412 | Y27T; D74S; N348R; W370I | + | + |
| 1425/1426 | Y27T; D74N; L253V; F254W; A255G | + | |
| 1435/1436 | Y27T; D74G; A255G; W370I | + | + |
| 1437/1438 | Y27T; D74G; L253V; A255G; N348R; D381W | + | + |
| 1439/1440 | Y27T; D74P; L253V; W370I | + | + |
| 1443/1444 | Y27T; D74G; L253V; F254W; A255G; W370I; D381K; T384P | ++ | + |
| 1445/1446 | Y27T; L253V; F254W; A255G; N348R; K369C; T384P | + | + |
| 1447/1448 | Y27T; D74N; F254W; A255G; N348R; W370I; D381K | + | + |
| 1453/1454 | Y27T; D74N; L253V; F254W; N348R; W370I; D381F | + | + |
| 1455/1456 | Y27T; D74S; F254W; A255G; N348R; W370I; D381F; T384P | + | + |
| 1457/1458 | Y27T; D74G; L253V; F254W; A255G; D381K | + | + |
| 1467/1468 | Y27T; D74G; F254W; A255G; N348R; W370I | + | + |
| 1469/1470 | Y27T; D74G; L253V; F254W; A255G; N348R; W370I; T384P | + | + |
| 1479/1480 | Y27T; D74S; L253V; N348R; D381W | + | + |
| 1485/1486 | Y27T; D74S; A255G | + | |

TABLE 12.6-continued

Acylation Results

| SEQ ID NO: (nt/aa) | Amino Acid Differences (Relative to SEQ ID NO: 1288) | B1/B29 Acylation Percent Conversion (FIOPC)[1] | B1/B29 Acylation Percent Selectivity (FIOPC)[2] |
|---|---|---|---|
| 1489/1490 | Y27T; D74S; L253V; A255G; N348R; W370I; D381K | + | + |
| 1493/1494 | Y27T; D74N; L253V; F254W; A255G; N348R; W370I; T384P | + | + |
| 1495/1496 | Y27T; D74S; F254W; A255G; W370I | + | + |
| 1503/1504 | Y27T; D74N; F254W; N348R | + | |
| 1505/1506 | Y27T; F254W; A255G; W370I | + | |
| 1511/1512 | Y27T; F254W; A255G; N348R; W370I | + | |
| 1521/1522 | Y27T; D74G; L253V; D381F; T384P | + | + |
| 1533/1534 | Y27T; D74P; W370I | + | |
| 1543/1544 | Y27T; D74N; L253V; F254W; A255G; W370I | + | + |
| 1545/1546 | Y27T; D74G; L253V; N348R; W370I | + | + |
| 1567/1568 | Y27T; L253V; F254W; N348R; W370I; T384P | + | + |
| 1573/1574 | Y27T; L253V; F254W; N348R; D381W; T384P | + | + |
| 1577/1578 | Y27T; L253V; F254W; A255G; G260C; N348R; D381F; T384P | + | + |
| 1579/1580 | Y27T; D74P; L253V; F254W; N348R; D381F; T384P | + | + |
| 1581/1582 | Y27T; D74G; L253V; F254W | + | + |
| 1585/1586 | Y27T; D74N; L253V; N348R | + | + |
| 1587/1588 | Y27T; D74G; L253V; A255G; N348R; T384P | + | + |
| 1589/1590 | Y27T; D74N; L253V; A255G; W370I | + | + |
| 1591/1592 | Y27T; D74N; A255G; N348R; W370I | + | + |
| 1597/1598 | Y27T; D74P; F254W; A255G; N348R; D381K; T384P | + | + |
| 1599/1600 | Y27T; F254W; A255G; N348R; W370I; D381W; T384P | + | + |
| 1601/1602 | Y27T; L253V; A255G; N348R; K369C; W370I | + | |
| 1605/1606 | Y27T; D74S; A255G; N348R; D381K; T384P | + | + |
| 1607/1608 | Y27T; D74P; L253V; F254W; N348R; W370I; D381W; T384P | + | + |
| 1609/1610 | Y27T; L253V; F254W; A255G; N348R; W370I; T384P | + | + |
| 1613/1614 | Y27T; D74G; F254W; N348R; D381W; T384P | + | + |
| 1617/1618 | Y27T; D74N; F254W; N348R; W370I | + | + |
| 1619/1620 | Y27T; D74P; L253V; F254W; N348R; K369C | + | + |
| 1625/1626 | Y27T; D74P; L253V; F254W; N348R | + | |
| 1629/1630 | Y27T; F254W; K369C; D381F; T384P | + | + |
| 1631/1632 | Y27T; L253V; F254W; N348R; W370I; D381F | + | + |
| 1635/1636 | Y27T; D74N; L253V; F254W; N348R; W370I | + | + |
| 1641/1642 | Y27T; F254W; N348R; K369C; W370I; D381N; T384P | + | + |
| 1657/1658 | Y27T; D74G; L253V; F254W; A255G; N348R | + | |
| 1767/1768 | D623N | + | + |
| 1769/1770 | T384R | + | + |
| 1771/1772 | D623L | + | + |
| 1835/1836 | F620R | ++ | +++ |
| 1837/1838 | D709N | +++ | +++ |
| 1859/1860 | K128W | ++ | ++ |
| 1861/1862 | T705E | ++ | ++ |
| 1869/1870 | A255E | ++ | ++ |
| 1873/1874 | F254T | ++ | ++ |

[1]The percent conversion was determined relative to the reference polypeptide of SEQ ID NO: 1288 and defined as follows: "+" = greater than 2-fold but less than 10-fold increased activity; "++" = greater than 10-fold but less than 50-fold increased activity; "+++" = greater than 50-fold but less than 100-fold increased activity; "++++" = greater than 100-fold increase activity.
[2]The percent selectivity was determined relative to the reference polypeptide of SEQ ID NO: 1288 and defined as follows: "+" = greater than 2-fold but less than 10-fold increased selectivity; "++" = greater than 10-fold but less than 50-fold increased selectivity; "+++" = greater than 50-fold but less than 100-fold increased selectivity; "++++" = greater than 100-fold increase selectivity.

TABLE 12.7

| SEQ ID NO: (nt/aa) | Amino Acid Differences (Relative to SEQ ID NO: 1288) | A1/B1/B29 Acylation Percent Conversion (FIOPC)[1] | A1/B1/B29 Acylation Percent Selectivity (FIOPC)[2] |
|---|---|---|---|
| 1313/1314 | Y27T; L253V; A255G; N348R; T384P | + | + |
| 1315/1316 | Y27T; L253V | + | + |
| 1317/1318 | Y27T; D74G; L253V; F254W | + | + |
| 1319/1320 | Y27T; D74S; F254W; N348R; D381W | + | + |
| 1321/1322 | Y27T; D74G; A255G; N348R; K369C; D381F; T384P | + | + |
| 1323/1324 | Y27T; D74G; L253V; A255G; N348R; W370I; T384P | + | + |
| 1325/1326 | Y27T; D74N; L253V; F254W; N348R; W370I; D381K; T384P | ++ | + |
| 1327/1328 | Y27T; D74N; L253V; F254W; A255G; N348R; W370I | + | + |
| 1329/1330 | Y27T; A255G; N348R; W370I | ++ | + |
| 1333/1334 | Y27T; N348R; T384P | + | + |
| 1335/1336 | Y27T; D74G; L253V; N348R; K369C; W370I; D381F; T384P | + | + |
| 1339/1340 | Y27T; D74P; L253V; F254W; A255G; N348R | + | + |
| 1341/1342 | Y27T | + | + |
| 1345/1346 | Y27T; D74G; L253V; F254W; A255G; W370I | + | + |
| 1347/1348 | Y27T; L253V; F254W; A255G | + | + |
| 1349/1350 | Y27T; D74G; L253V; F254W; T384P | + | + |
| 1351/1352 | Y27T; D74N; F254W; N348R; W370I | + | + |
| 1353/1354 | Y27T; D74S; L253V; N348R; W370I; D381K; T384P | ++ | ++ |
| 1355/1356 | Y27T; L253V; N348R | + | + |
| 1357/1358 | Y27T; L253V; A255G; W370I | + | + |
| 1359/1360 | Y27T; D74G; F254W; A255G; D381F | + | + |
| 1361/1362 | Y27T; F254W; N348R; T384P | + | |
| 1363/1364 | Y27T; D74G; F254W; A255G; N348R; D381W | + | + |
| 1367/1368 | D74N; F254W; A255G; N348R; T384P | + | + |
| 1369/1370 | Y27T; F254W; A255G | + | + |
| 1373/1374 | Y27T; D74S; N348R | + | + |
| 1375/1376 | Y27T; D74P; F254W; A255G; N348R | + | + |
| 1377/1378 | Y27T; L253V; F254W; N348R; D381F | + | + |
| 1381/1382 | Y27T; D74S; L253V; A255G; T384P | + | + |
| 1383/1384 | Y27T; D74G; A255G; W370I | ++ | + |
| 1387/1388 | Y27T; D74N; L253V; N348R; W370I; D381W; T384P | ++ | ++ |
| 1389/1390 | Y27T; D74G; L253V; F254W; N348R | ++ | + |
| 1393/1394 | Y27T; D74P; L253V; N348R | + | + |
| 1395/1396 | Y27T; L253V; F254W; A255G; N348R | + | + |
| 1397/1398 | Y27T; D74S; L253V; F254W; A255G; N348R | + | + |
| 1399/1400 | Y27T; D74G; F254W; A255G; N348R; K369C; W370I; D381F | + | + |
| 1401/1402 | Y27T; D74P; F254W; A255G; N348R; K369C; W370I | + | + |
| 1403/1404 | Y27T; D74N; L253V; F254W; W370I; D381K | ++ | ++ |
| 1405/1406 | Y27T; D74G; F254W; K369C; W370I | + | + |
| 1407/1408 | Y27T; D74G; L253V; N348R; W370I | ++ | + |
| 1409/1410 | Y27T; D74G; L253V; T384P | + | + |
| 1411/1412 | Y27T; D74S; N348R; W370I | ++ | + |
| 1415/1416 | Y27T; D74G; A255G; N348R | + | + |
| 1421/1422 | Y27T; D74G; F254W; A255G; N348R | + | + |
| 1423/1424 | Y27T; L253V; N348R; W370I; T384P | ++ | + |
| 1425/1426 | Y27T; D74N; L253V; F254W; A255G | + | + |
| 1433/1434 | Y27T; F254W; A449V | + | + |
| 1437/1438 | Y27T; D74G; L253V; A255G; N348R; D381W | + | + |
| 1439/1440 | Y27T; D74P; L253V; W370I | + | + |
| 1443/1444 | Y27T; D74G; L253V; F254W; A255G; W370I; D381K; T384P | ++ | ++ |
| 1447/1448 | Y27T; D74N; F254W; A255G; N348R; W370I; D381K | + | + |
| 1453/1454 | Y27T; D74N; L253V; F254W; N348R; W370I; D381F | ++ | ++ |
| 1455/1456 | Y27T; D74S; F254W; A255G; N348R; W370I; D381F; T384P | ++ | ++ |
| 1457/1458 | Y27T; D74G; L253V; F254W; A255G; D381K | ++ | + |
| 1459/1460 | Y27T; D74S; F254W; K369L; W370I | + | + |
| 1461/1462 | Y27T; D74N; F254W; A255G; N348R; K369C; D381F | + | + |
| 1463/1464 | Y27T; L253V; F254W; D381F; T384P | ++ | + |

TABLE 12.7-continued

Acylation Results

| SEQ ID NO: (nt/aa) | Amino Acid Differences (Relative to SEQ ID NO: 1288) | A1/B1/B29 Acylation Percent Conversion (FIOPC)[1] | A1/B1/B29 Acylation Percent Selectivity (FIOPC)[2] |
|---|---|---|---|
| 1467/1468 | Y27T; D74G; F254W; A255G; N348R; W370I | ++ | ++ |
| 1469/1470 | Y27T; D74G; L253V; F254W; A255G; N348R; W370I; T384P | + | + |
| 1471/1472 | L253V; N348R; W370I | + | + |
| 1473/1474 | Y27T; F254W; N348R; W370I | + | + |
| 1479/1480 | Y27T; D74S; L253V; N348R; D381W | ++ | ++ |
| 1481/1482 | Y27T; D74S; L253V; N348R | + | + |
| 1485/1486 | Y27T; D74S; A255G | + | + |
| 1487/1488 | Y27T; L253V; A255G; N348R | + | + |
| 1489/1490 | Y27T; D74S; L253V; A255G; N348R; W370I; D381K | + | + |
| 1493/1494 | Y27T; D74N; L253V; F254W; A255G; N348R; W370I; T384P | + | + |
| 1495/1496 | Y27T; D74S; F254W; A255G; W370I | ++ | + |
| 1497/1498 | Y27T; F254W; A255G; K369C; W370I; D381F; T384P | + | + |
| 1499/1500 | Y27T; A255G; N348R | + | + |
| 1501/1502 | Y27T; L253V; F254W; D381F | + | + |
| 1503/1504 | Y27T; D74N; F254W; N348R | + | + |
| 1505/1506 | Y27T; F254W; A255G; W370I | ++ | ++ |
| 1507/1508 | Y27T; L253V; N348R; D381F; T384P | + | + |
| 1511/1512 | Y27T; F254W; A255G; N348R; W370I | ++ | ++ |
| 1513/1514 | Y27T; L253V; F254W; N348R | + | + |
| 1515/1516 | Y27T; D74N; F254W | + | + |
| 1519/1520 | Y27T; D74N; F254W; N348R; K369C; D381F; T384P | + | + |
| 1521/1522 | Y27T; D74G; L253V; D381F; T384P | ++ | ++ |
| 1523/1524 | Y27T; D74P; L253V; A255G | + | + |
| 1529/1530 | Y27T; D74S; F254W; A255G; N348R; K369C; W370I | + | + |
| 1533/1534 | Y27T; D74P; W370I | ++ | + |
| 1537/1538 | Y27T; L253V; F254W; T384P | + | + |
| 1539/1540 | Y27T; D74N; N348R | + | + |
| 1541/1542 | Y27T; L253V; F254W; N348R; T384P | + | + |
| 1543/1544 | Y27T; D74N; L253V; F254W; A255G; W370I | + | + |
| 1547/1548 | Y27T; F254W; A255G; N348R | + | + |
| 1549/1550 | Y27T; D74S; F254W; N348R | + | + |
| 1551/1552 | Y27T; D74P; F254W; A255G; N348R; D381K; T384P | + | + |
| 1553/1554 | Y27T; F254W; A255G; N348R; W370I; T384P | ++ | ++ |
| 1559/1560 | Y27T; D74N; N348R; T384P | + | + |
| 1561/1562 | Y27T; D74S; K369C; W370I; D381K; T384P | + | + |
| 1563/1564 | Y27T; L253V; A255G; W370I; D381F; T384P | ++ | ++ |
| 1567/1568 | Y27T; L253V; F254W; N348R; W370I; T384P | ++ | + |
| 1569/1570 | Y27T; D74N; F254W; N348R; W370I; D381K | + | + |
| 1573/1574 | Y27T; L253V; F254W; N348R; D381W; T384P | ++ | + |
| 1575/1576 | Y27T; L253V; F254W | + | + |
| 1577/1578 | Y27T; L253V; F254W; A255G; G260C; N348R; D381F; T384P | + | + |
| 1579/1580 | Y27T; D74P; L253V; F254W; N348R; D381F; T384P | ++ | ++ |
| 1585/1586 | Y27T; D74N; L253V; N348R | + | + |
| 1587/1588 | Y27T; D74G; L253V; A255G; N348R; T384P | + | + |
| 1589/1590 | Y27T; D74N; L253V; A255G; W370I | + | + |
| 1591/1592 | Y27T; D74N; A255G; N348R; W370I | + | + |
| 1595/1596 | Y27T; N348R | + | + |
| 1599/1600 | Y27T; F254W; A255G; N348R; W370I; D381W; T384P | ++ | ++ |
| 1603/1604 | Y27T; L253V; D381F; T384P | + | + |
| 1605/1606 | Y27T; D74S; A255G; N348R; D381K; T384P | + | + |
| 1607/1608 | Y27T; D74P; L253V; F254W; N348R; W370I; D381W; T384P | ++ | ++ |
| 1609/1610 | Y27T; L253V; F254W; A255G; N348R; W370I; T384P | ++ | + |
| 1611/1612 | A255G; N348R; W370I | + | + |
| 1613/1614 | Y27T; D74G; F254W; N348R; D381W; T384P | ++ | ++ |
| 1615/1616 | Y27T; F254W; A255G; D381K; T384P | ++ | ++ |

TABLE 12.7-continued

Acylation Results

| SEQ ID NO: (nt/aa) | Amino Acid Differences (Relative to SEQ ID NO: 1288) | A1/B1/B29 Acylation Percent Conversion (FIOPC)[1] | A1/B1/B29 Acylation Percent Selectivity (FIOPC)[2] |
|---|---|---|---|
| 1621/1622 | Y27T; D74S; F254W; N348R; D381F | + | + |
| 1625/1626 | Y27T; D74P; L253V; F254W; N348R | + | + |
| 1631/1632 | Y27T; L253V; F254W; N348R; W370I; D381F | + | + |
| 1633/1634 | Y27T; D74G; L253V; A255G | + | + |
| 1635/1636 | Y27T; D74N; L253V; F254W; N348R; W370I | + | + |
| 1643/1644 | Y27T; D74G; L253V; F254W; A255G; N348R; K369C; W370I; D381F | + | + |
| 1645/1646 | Y27T; D74G; L253V; F254W; N348R; K369C; W370I | + | + |
| 1647/1648 | Y27T; A255G; N348R; D381W; T384P | + | + |
| 1649/1650 | Y27T; L253V; F254W; A255G; N348R; W370I | ++ | + |
| 1651/1652 | Y27T; F254W; N348R; D381W; T384P | + | + |
| 1653/1654 | Y27T; D74G; N348R | + | + |
| 1655/1656 | Y27T; D74N; L253V | + | + |
| 1657/1658 | Y27T; D74G; L253V; F254W; A255G; N348R | + | + |
| 1717/1718 | D623W | + | + |
| 1743/1744 | D623V | + | + |
| 1747/1748 | D623A | + | + |
| 1749/1750 | D381Q | + | + |
| 1771/1772 | D623L | + | + |
| 1795/1796 | D623N | + | + |
| 1797/1798 | T384R | ++ | + |
| 1823/1824 | A373K | + | + |
| 1827/1828 | F620R | + | + |
| 1863/1864 | F254I | + | + |
| 1865/1866 | A255P | + | + |

[1]The percent conversion was determined relative to the reference polypeptide of SEQ ID NO: 1288 and defined as follows: "+" = greater than 2-fold but less than 10-fold increased activity; "++" = greater than 10-fold but less than 50-fold increased activity; "+++" = greater than 50-fold increase activity.
[2]The percent selectivity was determined relative to the reference polypeptide of SEQ ID NO: 1288 and defined as follows: "+" = greater than 2-fold but less than 10-fold increased selectivity; "++" = greater than 10-fold but less than 50-fold increased selectivity; "+++" = greater than 50-fold increase selectivity.

Example 13

Acylation of Insulin with Alternative Acyl Donors

Acylation of the five variants listed in Table 13.1 using (methyl 2-(4-hydroxyphenyl)acetate or 2-(4-hydroxyphenyl)acetamide) as alternative to methyl phenylacetate was evaluated. The shake flask powders were produced as described in Example 4. The reactions were carried out in 96 well deep well plates, each containing 200 μL comprised of 0.1 M CHES, pH 10, 5% acetonitrile, 15 g/L insulin, 26 g/L acyl donor (methyl 2-(4-hydroxyphenyl)acetate or 2-(4-hydroxyphenyl)acetamide) and 1 g/L lyophilized enzyme powder. The HTP plates were heat-sealed and incubated in Thermotron® shakers (3 mm throw, model # AJ185, Infors) at 30° C., 300 rpm, for 2 hours. The reactions were quenched with 200 μl acetonitrile and mixed for 5 minutes using a bench top shaker. The plates were then centrifuged at 4000 rpm for 5 minutes and loaded into an HPLC for analysis.

Activity of each variant is calculated as percent conversion which was quantified by dividing the area of all product peaks by the sum of the areas of the substrate and various insulin products as determined by HPLC analysis.

TABLE 13.1

| SEQ ID NO: (nt/aa) | Amino Acid Differences (Relative to SEQ ID NO: 1262) | 2-(4-hydroxyphenyl) acetamide[1] | methyl 2-(4-hydroxyphenyl) acetate[1] |
|---|---|---|---|
| 1287/1288 | F71G; G74D | +++ | +++ |
| 1007/1008 | F24A; Y31W; V56I; F701W | ++ | + |
| 1019/1020 | F24A; Y31W; F71C; F701W | ++ | + |
| 1023/1024 | F24A; V56T; F701W | + | ++ |
| 1031/1032 | F24A; Y31W; V56I; F701Y | + | ++ |

[1]Percent conversion was defined as follows "+" = greater than 1% but less than 10% conversion; "++" = greater than 10.0% but less than 20% conversion; "+++" = greater than 20% conversion.

Example 14

Analytical Detection of Insulin and its Acylated Products

Data described in Examples 5-12 were collected using analytical methods in Tables 14.1, 14.2, 14.3, 14.4, and 14.5. The methods provided herein all find use in analyzing the variants produced using the present invention. The results shown in FIG. 1 correspond to elution order of the compounds for these methods.

TABLE 14.1

Analytical Method

| | |
|---|---|
| Instrument | Thermo LXQ |
| Column | Waters Xbridge C18 column: 50 × 3.0 mm, 5 um, with Phenomenex C18 guard Cartridge: 5 × 3.0 mm, 5 μm |
| Mobile Phase | Gradient (A: 0.2% formic acid in water; B: 0.2% formic acid in MeCN) |

| Time (min) | % A |
|---|---|
| 0.0 | 78 |
| 1.0 | 78 |
| 4.0 | 68 |
| 5.0 | 5.0 |
| 6.0 | 78 |
| 7.0 | 78 |

| | |
|---|---|
| Flow Rate | 0.7 mL/min |
| Run Time | 7 min |
| Column Temperature | 45° C. |
| Injection Volume | 10 μL |
| MS Detection | LXQ; divert flow from MS between 0-0.5 min. BP extracted ions for: insulin product = 968.6, 1162.6, 1453.0, 1937.0 mono-insulin product = 1189.5, 1486.5, 1981.5 di-insulin product = 1216.0, 11519.8 tri-insulin product = 1243.0, 1553.5 |
| MS Conditions | MS Polarity: Positive; Ionization: ESI; Mode: Q1 Scan from 300-2000; Source voltage: 20; Sheath gas: 40; Aux gas: 10; Cap temp: 350; Ionspray voltage: 5000; Cap V: 5; Tube lens: 55. |

TABLE 14.2

Analytical Method

| | |
|---|---|
| Instrument | Agilent HPLC 1200 series |
| Column | Ascentis Express C18, 4.6 × 100 or 150 mm, 2.7 uM |
| Mobile Phase | Gradient I (A: 0.05% TFA in water; B: 0.05% TFA in MeCN) |

| Time (min) | % A |
|---|---|
| 0.0 | 95 |
| 0.1 | 70 |
| 8, 8.5 or 9 | 50 |
| 8.1, 8.6 or 9.1 | 5 |
| 8.2, 8.7, or 9.2 | 95 |
| 9, 9.2 or 9.5 | 95 |

Gradient II ((A: 0.05% TFA in water; B: 0.05% TFA in MeCN)

| Time (min) | % A |
|---|---|
| 0 | 70 |
| 7 or 8 | 50 |
| 7.1 or 8.1 | 70 |
| 9 or 10 | 70 |

| | |
|---|---|
| Flow Rate | 1.0 mL/min |
| Run Time | ~10 min |
| Product Elution order | Insulin; A1-acylated insulin; B 29-acylated insulin; B1-acylated insulin; di-A1,B29-acylated insulin; di-A1,B1-acylated insulin; di-B1,B29-acylated insulin; tri-A1,B1,B29-acylated insulin |
| Column Temperature | 40° C. |
| Injection Volume | 5 μL |
| Detection | UV 218 nm and 280 nm Detector: MWD (Agilent 1200 series); Slit = 4 nm; peak width >0.1 min; Reference = 360; BW = 8 |

TABLE 14.3

Analytical Method

| | |
|---|---|
| Instrument | Agilent HPLC 1290 series |
| Column | Waters Cortecs UPLC C18 2.1 × 50 mm, 1.6 uM |
| Mobile Phase | Gradient (A: 0.05% TFA in water; B: 0.05% TFA in MeCN) for samples |

| Time (min) | % A |
|---|---|
| 0.0 | 72 |
| 2.5 | 50 |
| 2.51-2.7 | 10 |
| 2.71 | 72 |
| 3 | 72 |

Gradient (A: 0.05% TFA in water; B: 0.05% TFA in MeCN) for wash

| Time (min) | % A |
|---|---|
| 0.0 | 72 |
| 1.7 | 0 |
| 1.71-2 | 72 |

| | |
|---|---|
| Flow Rate | 0.9 mL/min |
| Run Time | 3 min |
| Product Elution order | Insulin; A1-acylated insulin; B 29-acylated insulin; B1-acylated insulin; di-A1,B29-acylated insulin; di-A1,B1-acylated insulin; di-B1,B29-acylated insulin; tri-A1,B1,B29-acylated insulin |
| Column Temperature | 40° C. |
| Injection Volume | 0.5 μL |
| Detection | UV 218 nm and 280 nm Detector: MWD (Agilent 1290 series); Slit = 4 nm; peak width >0.1 min; Reference = 360; BW = 8 |

TABLE 14.4

Analytical Method

| | |
|---|---|
| Instrument | Agilent HPLC 1200 series |
| Column | Ascentis Express C18, 4.6 × 100 or 150 mm, 2.7 uM |
| Mobile Phase | Gradient I (A: 0.05% TFA in water; B: 0.05% TFA in MeCN) |

| Time (min) | % A |
|---|---|
| 0.0 | 95 |
| 0.1 | 70 |
| 5, 6 or 8 | 50 |
| 5.5, 6.5, or 8.1 | 5 |
| 5.7 or 6.7 | 5 |
| 5.8, 6.8, or 8.2 | 95 |
| 6, 7, or 9 | 95 |

| | |
|---|---|
| Flow Rate | 1.0 mL/min |
| Run Time | ~10 min |
| Product Elution order | Insulin; A1-acylated insulin; B 29-acylated insulin; B1-acylated insulin; di-A1,B29-acylated insulin; di-A1,B1-acylated insulin; di-B1,B29-acylated insulin; tri-A1,B1,B29-acylated insulin |
| Column Temperature | 40° C. |
| Injection Volume | 5 μL |
| Detection | UV 218 nm and 280 nm Detector: MWD (Agilent 1200 series); Slit = 4 nm; peak width >0.1 min; Reference = 360; BW = 8 |

TABLE 14.5

Analytical Method

| | |
|---|---|
| Instrument | Agilent HPLC 1290 series |
| Column | Waters Cortecs UPLC C18 2.1 × 50 mm, 1.6 uM |
| Mobile Phase | Gradient (A: 0.05% TFA in water; B: 0.05% TFA in MeCN) for samples |

| Time (min) | % A |
|---|---|
| 0.0 | 72 |
| 1.5 | 50 |
| 1.51-1.7 | 10 |
| 1.71 | 72 |
| 2 | 72 |

| | |
|---|---|
| Flow Rate | 0.9 mL/min |
| Run Time | 3 min |
| Product Elution order | Insulin; A1-acylated insulin; B 29-acylated insulin; B1-acylated insulin; di-A1,B29-acylated insulin; di-A1,B1-acylated insulin; di-B1,B29-acylated insulin; tri-A1,B1,B29-acylated insulin |

TABLE 14.5-continued

Analytical Method

| | |
|---|---|
| Column Temperature | 40° C. |
| Injection Volume | 0.5 µL |
| Detection | UV 218 nm and 280 nm Detector: MWD (Agilent 1290 series); Slit = 4 nm; peak width >0.1 min; Reference = 360; BW = 8 |

All publications, patents, patent applications and other documents cited in this application are hereby incorporated by reference in their entireties for all purposes to the same extent as if each individual publication, patent, patent application or other document were individually indicated to be incorporated by reference for all purposes.

While various specific embodiments have been illustrated and described, it will be appreciated that various changes can be made without departing from the spirit and scope of the invention(s).

SEQUENCE LISTING (1902 sequences)

SEQ ID NO: 1 - DNA, 2541 bp, Artificial Sequence
  Penicillin-G Acylates from K. citrophila
atgaaaaatagaaatcgtatgatcgtgaacggtattgtgacttccctgatctgttgttctagcctgtcagcgctggcggcaagcccgccaaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccggttttctgacagcaccagcgaaattgataacctggcgctgctgacggcgctaaaagataaatacggcaagcagcagggcatggcggtctttaaccagctgaaatggctggttaatccttccgcgccaaccaccattgcggcgcgggaaagcgcctatccgctgaagtttgatctgcaaaacacgcaaacggcggcgctgctgccgcgctacgaccagccggcaccgatgctcgaccgcccggcaaaagggaccgatggcgcgctgctggcgctgaccgccgatcagaaccgggaaactatcgccgcgcagttcgcgcaaagcggcgctaacggcctggctggctacccgaccactagcaatatgtgggtgattggcaaaaacaaagcccaggatgcgaaggccattatggtcaatgggccgcagtttggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggcaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtgatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagcgctaa

SEQ ID NO: 2 - protein, 846 aa, Artificial Sequence
  Penicillin-G Acylates Variant from K. citrophila
MKNRNRMIVNGIVTSLICCSSLSALAASPPTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTAALLPRYDQPAPMLDRPAKGTDGALLALTADQNRETIAAQFAQSGANGLAGYPTTSNMWVIGKNKAQDAKAIMVNGPQFGWYAPAYTYGIGLHGAGYDVTGNTPFAYPGLVFGHNGTISWGSTAGFGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQR

SEQ ID NO: 3 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 4 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 5 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtataatccggcgtatacctacggtatcggcctgcacggcgcgggctatgacgtcaccggcaatacgccgtttgcctatccgggcctcctttttggtcacaacggcaccatttcatggggatccaccgccggtgccggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgttaagtttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 6 - protein, 764 aa, Artificial Sequence
  Penicillin-G Acylates Variant from K. citrophila
SNMWVIGKNKAQDAKAIMVNGPQFGWYNPAYTYGIGLHGAGYDVTGNTPFAYPGLLFGHNGTISWGSTAGAGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENNMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVKFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 7 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 8 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 9 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggatgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 10 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 11 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgtgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggatgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgtttttcggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccctggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 12 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENNMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFFGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 13 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 14 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 15 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaataccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 16 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDNTSEIDNLALLTALKDKYGKQQGMAVFNQLKWLVNPSAPTTIAARESAYPLKFDLQNTQTA

SEQ ID NO: 17 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgaaaaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 18 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSKNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 19 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 20 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 21 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 22 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 23 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 24 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 25 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagcaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 26 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKAIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 27 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 28 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 29 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggcggtctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 30 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGGLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 31 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagccgtagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 32 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 33 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccacaggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 34 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 35 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgcgtaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 36 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSRNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 37 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatatttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 38 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 39 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattatttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 40 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 41 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggacagtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 42 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 43 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 44 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 45 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggcgcactgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 46 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGALNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 47 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcatggaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 48 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAWKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 49 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccaccgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 50 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTTEIDNLALLTALKDKYGKQQGMAVFNQLKWLVNPSAPTTIAARESAYPLKFDLQNTQTA

SEQ ID NO: 51 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgaaagcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 52 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLKAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 53 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 54 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 55 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtaccttgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 56 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYLASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 57 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 58 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 59 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcatttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 60 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 61 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccgcaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 62 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAANFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 63 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagagtgtcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 64 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKECRHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 65 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 66 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 67 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacctatgacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccttaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 68 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTYDGPTGSLNIKVGAKILYEALQGDKSPIPQAVDLFGGKPQQEVILAALDDAWQTLSKRYGNDVTGWKTPAMALTFRALNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 69 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggccatctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 70 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGHLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 71 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcaaaagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 72 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSKSGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 73 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcatgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 74 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 75 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 76 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 77 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 78 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSELDNLALLTALKDKYGKQQGMAVFNQLKWLVNPSAPTTIAARESAYPLKFDLQNTQTA

SEQ ID NO: 79 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgagtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 80 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFASLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 81 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcagtgtgagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 82 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQCEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 83 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccatggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 84 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTMDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 85 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgatcaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 86 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDQVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 87 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 88 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 89 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 90 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDAQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 91 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgatcaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 92 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDQVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 93 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 94 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 95 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 96 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 97 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctacaaaacacgcaaacggcgtaa

SEQ ID NO: 98 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 99 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 100 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 101 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 102 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 103 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 104 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 105 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 106 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 107 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgatcaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 108 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDQVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 109 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacaggatcctcgatgctcaaccgcgcttcaccgccgatcaggcgtgggatgtgatccgccaaaccagccgtcgggatctcaacctgcggttgttcttaccggcgctgcaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 110 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDRILDAQPRFTADQAWDVIRQTSRRDLNLRLFLPALQDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 111 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 112 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 113 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 114 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 115 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 116 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 117 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 118 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 119 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgatgctcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 120 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALQDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 121 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgatcaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 122 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDQVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 123 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 124 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 125 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 126 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 127 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 128 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 129 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 130 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 131 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 132 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 133 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 134 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 135 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 136 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 137 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 138 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 139 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 140 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 141 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 142 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 143 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 144 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 145 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 146 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 147 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 148 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 149 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggcaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 150 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAANDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 151 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacaggatcctcgatgctcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 152 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDAQPRFTADQAWDVIRQTSRRDLNLRLFLPALKDATANLAANDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 153 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 154 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 155 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 156 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDAQPRFTADQAWDVIRQTSRRDLNLRLFLPALKDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 157 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 158 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 159 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacaggatcctcgatgctcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 160 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDRILDAQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 161 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 162 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 163 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 164 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 165 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggatatatcgccaactggaacaactcgccgcaaaaagactacccggcctctgatctgttcgcgttcctgtggggcggtgcggatcgagttactgagatcgacaggatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 166 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDRILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 167 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgatcaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 168 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDQVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 169 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 170 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALKDATANLAANDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 171 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgatgctcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 172 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 173 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 174 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 175 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 176 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 177 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 178 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 179 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacaggatcctcgataagcaaccgcgcttcaccgccgatcaggcgtgggatgtgatccgccaaaccagccgtcgggatctcaacctgcggttgttcttaccggcgctgcaagacgccaccgcgaacctggcggcaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 180 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDRILDKQPRFTADQAWDVIRQTSRRDLNLRLFLPALQDATANLAANDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 181 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 182 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 183 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgatgctcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 184 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDAQPRFTADQAWDVIRQTSRRDLNLRLFLPALQDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 185 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 186 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALQDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 187 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 188 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 189 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacaggatcctcgatgctcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 190 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDAQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 191 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 192 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDAQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 193 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacaggatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 194 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDKQPRFTADQAWDVIRQTSRRDLNLRLFLPALQDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 195 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 196 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 197 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggcgcggatcgagttactgagatcgacaggatcctcgatgctcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 198 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDAQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 199 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 200 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 201 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacaggatcctcgatgctcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 202 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDAQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 203 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 204 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 205 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggtgcggatcgagttactgagatcgacaggatcctcgataagcaaccgcgcttcaccgccgatcaggcgtgggatgtgatccgccaaaccagccgtcgggatctcaacctgcggttgttcttaccggcgctgaaagacgccaccgcgaacctggcggcaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 206 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDRILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 207 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgatgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcaatcgggctatatcgccaactggaacaactcgccgcaaaaagactacccggcctctgatctgttcgcgttcctgtggggcggcgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 208 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDDATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALQDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 209 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 210 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 211 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 212 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 213 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 214 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 215 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgatgctcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 216 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDAQPRFTADQAWDVIRQTSRRDLNLRLFLPALKDATANLAANDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 217 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaagacgccaccgcgaacctggcggaaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccggttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcacagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 218 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 219 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 220 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 221 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgcaagacgccaccgcgaacctggcggaaaacgatccgcgccgccaactggtggataaactggccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcaaacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagacattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 222 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALQDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 223 - DNA, 2295 bp, Artificial Sequence
  Penicillin-G Acylates Variant from K. citrophila
agcaatatgtgggtgattggcaaaagcaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgctgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggcaaacgatccgcgccgccaactggtggataaactgaccagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttgggaaacgctgtcaaaacgctacggtaacgacgtcaccaattggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaaagcattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 224 - protein, 764 aa, Artificial Sequence
  Penicillin-G Acylates Variant from K. citrophila
SNMWVIGKSKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAANDPRRQLVDKLTSWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWETLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 225 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 226 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 227 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccagtaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 228 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRASNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 229 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagctattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 230 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKAIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 231 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 232 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 233 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 234 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 235 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 236 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 237 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 238 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 239 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 240 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 241 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 242 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 243 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 244 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 245 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 246 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 247 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 248 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 249 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 250 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 251 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 252 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 253 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 254 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 255 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagtacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 256 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEYKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 257 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacagattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 258 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 259 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 260 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 261 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 262 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 263 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 264 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 265 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 266 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 267 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 268 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 269 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 270 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 271 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 272 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 273 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 274 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 275 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 276 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 277 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 278 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 279 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcttggctgaccagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagctattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 280 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKAIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 281 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagccgtaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 282 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 283 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 284 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 285 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaaaacattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 286 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKNIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 287 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 288 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 289 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 290 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 291 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 292 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 293 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 294 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 295 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 296 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 297 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 298 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 299 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 300 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 301 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 302 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 303 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 304 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRSGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 305 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 306 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 307 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 308 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 309 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 310 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 311 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacagattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 312 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 313 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaggtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 314 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 315 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagccgtagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 316 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 317 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgagtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 318 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNEFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 319 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 320 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRSGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 321 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 322 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 323 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 324 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 325 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 326 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 327 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 328 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 329 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 330 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 331 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 332 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 333 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 334 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 335 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaaaacattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 336 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKNIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 337 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 338 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 339 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagccaggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 340 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 341 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 342 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 343 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 344 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 345 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 346 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 347 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 348 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 349 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 350 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 351 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 352 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 353 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 354 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 355 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 356 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 357 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 358 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 359 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 360 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 361 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 362 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 363 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 364 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 365 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 366 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 367 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggatatatcgccaactggaacaactcgccgcaaaaagactacccggcctctgatctgttcgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 368 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 369 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggacttcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 370 - protein, 764 aa, Artificial Sequence
  Penicillin-G Acylates Variant from K. citrophila
SNMWVIGKNKAQDAKAIMVNGPQFGWTSPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 371 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 372 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 373 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 374 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 375 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 376 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 377 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 378 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 379 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 380 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 381 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagccgtagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 382 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 383 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 384 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 385 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctctttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 386 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 387 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 388 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 389 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaacattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 390 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKNIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 391 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaacagattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 392 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 393 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 394 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 395 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 396 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 397 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaacattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 398 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKNIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 399 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctcaacgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagccgtaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 400 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLNAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSRTGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 401 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 402 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 403 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtagcggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 404 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRSGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 405 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 406 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 407 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagcggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcccttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 408 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAYLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 409 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaacagattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 410 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSATGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 411 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcactttgcgtatctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagcgccaccggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagccttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 412 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDHFAYLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSATGYETTLDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 413 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgacaagcatgctcaagcgcacggtggttgccgcggtcccagcgccgtttggtaagtggtacagcgccagtggctatgaaaccaccctggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaacagattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 414 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTLDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKQIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 415 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttcatgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 416 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFHGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 417 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccacatggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 418 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTTWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 419 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggatggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 420 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 421 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 422 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAADESAYPLKFDLQNTQTA

SEQ ID NO: 423 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccagttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 424 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTSWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 425 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccctttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 426 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTLWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 427 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgggttgtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 428 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTGCNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 429 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagtgaaagcgcctatccgctgaagtttgatctgcaaaacacgcaaacggcgtaa

SEQ ID NO: 430 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 431 - DNA, 2295 bp, Artificial Sequence
  Penicillin-G Acylates Variant from K. citrophila
agcaatatgtgggtgattggcaaagataaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 432 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 433 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggtgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 434 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 435 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 436 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 437 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcacccaatggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 438 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTQWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 439 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcacccgttggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 440 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTRWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 441 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaaatggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 442 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTKWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 443 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaagataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 444 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 445 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 446 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 447 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcgatggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 448 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVDGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 449 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 450 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDNTSELDNLALLTALKDKYGKQQGMAVFNQLKWLVNPSAPTTIAARESAYPLKFDLQNTQTA

SEQ ID NO: 451 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagctaaagagtgccgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 452 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKECRHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 453 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 454 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 455 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgaaagcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagcaaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 456 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLKAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDNTSEIDNLALLTALKDKYGKQQGMAVFNQLKWLVNPSAPTTIAARESAYPLKFDLQNTQTA

SEQ ID NO: 457 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtactcggccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 458 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDNTSELDNLALLTALKDKYGKQQGMAVFNQLKWLVNPSAPTTIAARESAYPLKFDLQNTQTA

SEQ ID NO: 459 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccaccatggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 460 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTMDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 461 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 462 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 463 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 464 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 465 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccaccgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 466 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDNTTEIDNLALLTALKDKYGKQQGMAVFNQLKWLVNPSAPTTIAARESAYPLKFDLQNTQTA

SEQ ID NO: 467 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacttggccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 468 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYLASGYETTQDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSELDNLALLTALKDKYGKQQGMAVFNQLKWLVNPSAPTTIAARESAYPLKFDLQNTQTA

SEQ ID NO: 469 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagctaaagagtgccgtcatcagtgcgagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 470 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRAQNFFGVPQAAAKECRHQCEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 471 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccaccgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 472 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDNTTELDNLALLTALKDKYGKQQGMAVFNQLKWLVNPSAPTTIAARESAYPLKFDLQNTQTA

SEQ ID NO: 473 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtactcggccagtggctatgaaaccaccatggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 474 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTMDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 475 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggcagtctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcatggaaagagtgccgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacaacaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 476 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAWKECRHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDNTSELDNLALLTALKDKYGKQQGMAVFNQLKWLVNPSAPTTIAARESAYPLKFDLQNTQTA

SEQ ID NO: 477 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacttggccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcccagaacttcttcggcgtgccgcaggcggcagctaaagaggaacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcactaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 478 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYLASGYETTQDGPTGSLNIKVGAKILYEALQGDKSPIPQAVDLFGGKPQQEVILAALDDAWQTLSKRYGNDVTGWKTPAMALTFRAQNFFGVPQAAAKEERHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 479 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 480 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 481 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaacagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtactcggccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagctaaagagtgccgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaacttgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 482 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKECRHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSELDNLALLTALKDKYGKQQGMAVFNQLKWLVNPSAPTTIAARESAYPLKFDLQNTQTA

SEQ ID NO: 483 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcacgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaaaaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 484 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKKIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 485 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaccagcatgctcaagcgcacggtggttgccgcggtcccagcgccgtttggtaagtggtacagcgccagtggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 486 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILHAWLTSMLKRTVVAAVPAPFGKWYSASGYETTQDGPTGSLNIKVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 487 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 488 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 489 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 490 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 491 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 492 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 493 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 494 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 495 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 496 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 497 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 498 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 499 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 500 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 501 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 502 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 503 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 504 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 505 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactattttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 506 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 507 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 508 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 509 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 510 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 511 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacgacaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 512 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNDTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 513 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 514 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 515 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 516 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 517 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 518 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 519 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 520 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 521 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 522 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 523 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagacccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 524 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNARPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 525 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 526 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 527 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 528 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 529 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 530 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 531 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 532 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 533 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaatacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 534 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWNTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 535 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcgatagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 536 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 537 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 538 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 539 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 540 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 541 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcagtctttaaccagctgaaatggctggttaatccttccgcgccaaccaccattgcggcgcgggaaagcgcctatccgctgaagtttgatctgcaaaacacgcaaacggcgtaa

SEQ ID NO: 542 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 543 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 544 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 545 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 546 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 547 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 548 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 549 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 550 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 551 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 552 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 553 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 554 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 555 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 556 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 557 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 558 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 559 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 560 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 561 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcagtctttaaccagctgaaatggctggttaatccttccgcgccaaccaccattgcggcgagcgaaagcgcctatccgctgaagtttgatctgcaaaacacgcaaacggcgtaa

SEQ ID NO: 562 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 563 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 564 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 565 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 566 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 567 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 568 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 569 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 570 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 571 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 572 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 573 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 574 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 575 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 576 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 577 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 578 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 579 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 580 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 581 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 582 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 583 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 584 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 585 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 586 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 587 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 588 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 589 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 590 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 591 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 592 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 593 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 594 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 595 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 596 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 597 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcagtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 598 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 599 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcagtctttaaccagctgaaatggctggttaatccttccgcgccaaccaccattgcggcggatgaaagcgcctatccgctgaagtttgatctgcaaaacacgcaaacggcgtaa

SEQ ID NO: 600 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 601 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcagtctttaaccagctgaaatggctggttaatccttccgcgccaaccaccattgcggcgagcgaaagcgcctatccgctgaagtttgatctgcaaaacacacaaacggcgtaa

SEQ ID NO: 602 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 603 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 604 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 605 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 606 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 607 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaattggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 608 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 609 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 610 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 611 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 612 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 613 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 614 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 615 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 616 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 617 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 618 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 619 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccccgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 620 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 621 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcagtctttaaccagctgaaatggctggttaatccttccgcgccaaccaccattgcggcgagcgaaagcgcctatccgctgaagtttgatctgcaaaacacgcaaacggcgtaa

SEQ ID NO: 622 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 623 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 624 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 625 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 626 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 627 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 628 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAADESAYPLKFDLQNTQTA

SEQ ID NO: 629 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 630 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 631 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 632 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 633 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 634 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 635 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 636 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 637 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 638 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 639 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 640 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 641 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 642 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAADESAYPLKFDLQNTQTA

SEQ ID NO: 643 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 644 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 645 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 646 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 647 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 648 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 649 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 650 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 651 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 652 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 653 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcagtctttaaccagctgaaatggctggttaatccttccgcgccaaccaccattgcggcgagcgaaagcgcctatccgctgaagtttgatctgcaaaacacgcaaacggcgtaa

SEQ ID NO: 654 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 655 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 656 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 657 - DNA, 2295 bp, Artificial Sequence
  Penicillin-G Acylates Variant from K. citrophila
agcaatatgtgggtgattggcaaagacaaagcccaggatgcgatggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 658 - protein, 764 aa, Artificial Sequence
  Penicillin-G Acylates Variant from K. citrophila
SNMWVIGKDKAQDAMAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 659 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 660 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 661 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 662 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 663 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 664 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 665 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 666 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 667 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcagtctttaaccagctgaaatggctggttaatccttccgcgccaaccaccattgcggcgcgggaaagcgcctatccgctgaagtttgatctgcaaaacacgcaaacggcgtaa

SEQ ID NO: 668 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 669 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 670 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 671 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 672 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 673 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 674 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 675 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 676 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGEQQGMAVFNQLKWLVNPSAPTTIAAEESAYPLKFDLQNTQTA

SEQ ID NO: 677 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 678 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 679 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 680 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 681 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 682 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 683 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 684 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 685 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcagtctttaaccagctgaaatggctggttaatccttccgcgccaaccaccattgcggcgcgggaaagcgcctatccgctgaagtttgatctgcaaaacacgcaaacggcgtaa

SEQ ID NO: 686 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 687 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 688 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 689 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 690 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 691 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 692 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 693 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 694 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 695 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 696 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 697 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 698 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 699 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgccacaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 700 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 701 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 702 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 703 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 704 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 705 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 706 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 707 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 708 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 709 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 710 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 711 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 712 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 713 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 714 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 715 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 716 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 717 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 718 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 719 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 720 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 721 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 722 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 723 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 724 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 725 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 726 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 727 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 728 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVNKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 729 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 730 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAADESAYPLKFDLQNTQTA

SEQ ID NO: 731 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 732 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 733 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 734 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 735 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 736 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 737 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 738 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 739 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 740 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 741 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 742 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 743 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 744 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 745 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 746 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 747 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 748 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 749 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 750 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 751 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 752 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 753 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 754 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 755 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 756 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 757 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 758 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 759 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 760 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 761 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 762 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 763 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 764 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 765 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 766 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 767 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 768 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 769 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 770 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 771 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 772 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 773 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcgataaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 774 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVDKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 775 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 776 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 777 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 778 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 779 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 780 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAASESAYPLKFDLQNTQTA

SEQ ID NO: 781 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 782 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 783 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 784 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 785 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 786 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 787 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 788 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 789 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 790 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 791 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 792 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 793 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 794 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 795 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 796 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 797 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 798 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 799 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 800 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAADESAYPLKFDLQNTQTA

SEQ ID NO: 801 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 802 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 803 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 804 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 805 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 806 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 807 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcacccagtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 808 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTQWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAARESAYPLKFDLQNTQTA

SEQ ID NO: 809 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 810 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 811 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 812 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 813 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggatgaaagcgcctatccgctgaagtttgatctgcaaaacacgcaaacggcgtaa

SEQ ID NO: 814 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAADESAYPLKFDLQNTQTA

SEQ ID NO: 815 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 816 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 817 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccagttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcaatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 818 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTSWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 819 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgcgaaagcgcctatccgctgaagtttgatctgcaaaacacgcaaacggcgtaa

SEQ ID NO: 820 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 821 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 822 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 823 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 824 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 825 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcggcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 826 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTRQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 827 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcgatcgttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 828 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVDRWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 829 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 830 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 831 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 832 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 833 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaaatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgagcgaaagcgcctatccgctgaagtttgatctgcaaaacacgcaaacggcgtaa

SEQ ID NO: 834 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTKWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAASESAYPLKFDLQNTQTA

SEQ ID NO: 835 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggagggaaaccgcagcaggaagtaatactggcggcgctggacgacgcttggcagacgctgtcaaaacgctacggtaacgacgtcaccggttggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagctgataagcactatgacgatcagctgaaaatgtacgagagctttggccgtaaatcgctgtggttaacgcctcaggacgttgacgagcacaaagagtctcaggaagtgctgcaggtacagttggatcagactgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 836 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAAEESAYPLKFDLQNTQTA

SEQ ID NO: 837 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtggacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccacatggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaaaaggataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 838 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVDGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTTWKTPAMKLTFRANNFFGVPQAAAKEARHQAEYQNRGTENDMIVFSPTSGNRPVLAWDVVAPGQSGFIAPDGKKDKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 839 - DNA, 2295 bp, Artificial Sequence
  Penicillin-G Acylates Variant from K. citrophila
agcaatatgtgggtgattggcaaagacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttcacgggaaaccgcagcaggaagtaatactggcggcgctggacgacgcttggcagacgctgtcaaaacgctacggtaacgacgtcaccctgtggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagggcgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcgatcagcagggcatggcggtctttaaccagctgaaatggctggttaatccttccgcgccaaccaccattgcggcggaagaaagcgcctatccgctgaagtttgatctgcaaaacacgcaaacggcgtaa

SEQ ID NO: 840 - protein, 764 aa, Artificial Sequence
  Penicillin-G Acylates Variant from K. citrophila
SNMWVIGKDKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFHGKPQQEVILAALDDAWQTLSKRYGNDVTLWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQGEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGDQQGMAVFNQLKWLVNPSAPTTIAAEESAYPLKFDLQNTQTA

SEQ ID NO: 841 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 842 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 843 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 844 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 845 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 846 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 847 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 848 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 849 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 850 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 851 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 852 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 853 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 854 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 855 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcaaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 856 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 857 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 858 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 859 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 860 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 861 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 862 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 863 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 864 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 865 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 866 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 867 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaatggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 868 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 869 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 870 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 871 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 872 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 873 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 874 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 875 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 876 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 877 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 878 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRAQNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 879 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 880 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 881 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 882 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 883 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 884 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 885 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 886 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 887 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 888 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 889 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 890 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 891 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 892 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 893 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 894 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 895 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 896 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 897 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 898 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 899 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 900 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 901 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 902 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 903 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 904 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 905 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 906 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 907 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 908 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 909 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 910 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 911 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 912 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 913 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 914 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 915 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 916 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 917 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 918 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 919 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 920 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 921 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 922 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 923 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 924 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 925 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 926 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 927 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 928 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 929 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 930 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 931 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 932 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 933 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 934 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 935 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 936 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 937 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 938 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 939 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 940 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 941 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 942 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 943 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 944 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 945 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaatgggatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattacaatgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggcccaaaacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 946 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKWDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYNAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRAQNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 947 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtgaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 948 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGDRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 949 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgtttctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatgaaacttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 950 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFAFLWGGADRVTEIDTILDKQPRFTADQAWDVIRQTSRRDLNLRLFLPALKDATANLAENDPRRQLVDKLASWDGENLVNDDGKTYQQPGSAILHAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTNWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKDILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 951 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagttcggttggactgcgccggcgtatacctacggtatcggcctgcacggcgcgggctatgacgtcaccggcaatacgccgtttgcctatccgggcctcgtttttggtcacaacggcaccatttcatggggatccaccgccggtcacggtgatggggtcgatatctttgccgaaaaactttccgccgagaagccgggctattaccagcataacggcgagtgggtgaagatgttgagccgcaaagagactattgcggtcaaagacggccagccggagacctttaccgtttatcgcacgctgcacggcaacgtcattaaaactgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgattactttgcgcgtctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaaaagcatgctcaagcgcacggtggttgccgcggtcccagcgccgtttggtaagtggtacagccgtaccggctatgaaaccacccaggacgggccaaccggctcgctgaacatcaaagtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatgaaacttaccttccgggccaacaacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaatacttcgtcagttttgataaagatattcgccagaactactggccggattctattcgcgcgcagatagcttccctctccgctgaggataaaagtattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 952 - protein, 764 aa, Artificial Sequence
  Penicillin-G Acylates Variant from K. citrophila
SNMWVIGKNKAQDAKAIMVNGPQFGWTAPAYTYGIGLHGAGYDVTGNTPFAYPGLVFGHNGTISWGSTAGHGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDYFARLWGGADRVTEIDTILDKQPRFTADQAWDVIRQTSRRDLNLRLFLPALKDATANLAENDPRRQLVDKLASWDGENLVNDDGKTYQQPGSAILNAWLKSMLKRTVVAAVPAPFGKWYSRTGYETTQDGPTGSLNIKVGAKILYEALQGDKSPIPQAVDLFGGKPQQEVILAALDDAWQTLSKRYGNDVTGWKTPAMKLTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKYFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 953 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgctcgccagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 954 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDARQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 955 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtctgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 956 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRLSDSTSEIDNLALLTALKDKYGKQQGMAVFNQLKWLVNPSAPTTIAARESAYPLKFDLQNTQTA

SEQ ID NO: 957 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtgcgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 958 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRASDSTSEIDNLALLTALKDKYGKQQGMAVFNQLKWLVNPSAPTTIAARESAYPLKFDLQNTQTA

SEQ ID NO: 959 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 960 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 961 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgtgggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 962 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGVGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 963 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaaaggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 964 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGKGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 965 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgaaggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 966 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGEGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 967 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 968 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 969 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccctggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 970 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 971 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccactaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 972 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTTNWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 973 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtttacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgccgaagtttgatctgcaaaacacgcaaacggcgtaa

SEQ ID NO: 974 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPPKFDLQNTQTA

SEQ ID NO: 975 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 976 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGCGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 977 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtgtttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 978 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRVSDSTSEIDNLALLTALKDKYGKQQGMAVFNQLKWLVNPSAPTTIAARESAYPLKFDLQNTQTA

SEQ ID NO: 979 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 980 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 981 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttgttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 982 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRCSDSTSEIDNLALLTALKDKYGKQQGMAVFNQLKWLVNPSAPTTIAARESAYPLKFDLQNTQTA

SEQ ID NO: 983 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatttctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 984 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRISDSTSEIDNLALLTALKDKYGKQQGMAVFNQLKWLVNPSAPTTIAARESAYPLKFDLQNTQTA

SEQ ID NO: 985 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatgtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 986 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRMSDSTSEIDNLALLTALKDKYGKQQGMAVFNQLKWLVNPSAPTTIAARESAYPLKFDLQNTQTA

SEQ ID NO: 987 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 988 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRFSDSTSEIDNLALLTALKDKYGKQQGMAVFNQLKWLVNPSAPTTIAARESAYPLKFDLQNTQTA

SEQ ID NO: 989 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccggggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 990 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTGANRFSDSTSEIDNLALLTALKDKYGKQQGMAVFNQLKWLVNPSAPTTIAARESAYPLKFDLQNTQTA

SEQ ID NO: 991 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgtttacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 992 - protein, 764 aa, Artificial Sequence
  Penicillin-G Acylates Variant from K. citrophila
SNMWVIGKNKAQDAKAIMVNGPQFGWYAPAFTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 993 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgttgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 994 - protein, 764 aa, Artificial Sequence
  Penicillin-G Acylates Variant from K. citrophila
SNMWVIGKNKAQDAKAIMVNGPQFGWYAPALTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 995 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcggtgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 996 - protein, 764 aa, Artificial Sequence
  Penicillin-G Acylates Variant from K. citrophila
SNMWVIGKNKAQDAKAIMVNGPQFGWYAPAVTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 997 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgactacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 998 - protein, 764 aa, Artificial Sequence
  Penicillin-G Acylates Variant from K. citrophila
SNMWVIGKNKAQDAKAIMVNGPQFGWYAPATTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 999 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgtgtacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1000 - protein, 764 aa, Artificial Sequence
  Penicillin-G Acylates Variant from K. citrophila
SNMWVIGKNKAQDAKAIMVNGPQFGWYAPACTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1001 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgaatacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1002 - protein, 764 aa, Artificial Sequence
  Penicillin-G Acylates Variant from K. citrophila
SNMWVIGKNKAQDAKAIMVNGPQFGWYAPANTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1003 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgatgacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1004 - protein, 764 aa, Artificial Sequence
  Penicillin-G Acylates Variant from K. citrophila
SNMWVIGKNKAQDAKAIMVNGPQFGWYAPAMTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1005 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgaagacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1006 - protein, 764 aa, Artificial Sequence
  Penicillin-G Acylates Variant from K. citrophila
SNMWVIGKNKAQDAKAIMVNGPQFGWYAPAKTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1007 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcataa

SEQ ID NO: 1008 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1009 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1010 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1011 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtgtacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggcccgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1012 - protein, 764 aa, Artificial Sequence
  Penicillin-G Acylates Variant from K. citrophila
SNMWVIGKNKAQDAKAIMVNGPQAGWYVPACTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGPLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1013 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1014 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1015 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatgtgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1016 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDVNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1017 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgtgctactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaggcgcctatccgctgaagtttgatctgcaaaacacgcaaacggcgtaa

SEQ ID NO: 1018 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAAREGAYPLKFDLQNTQTA

SEQ ID NO: 1019 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1020 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1021 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctacaaaacacgcaaacggcgtaa

SEQ ID NO: 1022 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENNMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1023 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1024 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1025 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1026 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1027 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgttcacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacggtcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1028 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTVLDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 1029 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgttaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcagaaaacgatccgcgccgccaactggtggataaactggctagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1030 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRWSDSTSEIDNLALLTALKDKYGKQQGMAVFNQLKWLVNPSAPTTIAARESAYPLKFDLQNTQTA

SEQ ID NO: 1031 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1032 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1033 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtggacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1034 - protein, 764 aa, Artificial Sequence
  Penicillin-G Acylates Variant from K. citrophila
SNMWVIGKNKAQDAKAIMVNGPQAGWYVPAWTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRFSDSTSEIDNLALLTALKDKYGKQQGMAVFNQLKWLVNPSAPTTIAARESAYPLKFDLQNTQTA

SEQ ID NO: 1035 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1036 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1037 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccacgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccgcccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1038 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATTNLAENDPRRQLVDKLASWDGENLVNDDGKTYQQPGSAILNAWLTSMLKRTVVAAVPAPFGKWYSASGYETAQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1039 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtgaataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1040 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVNKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 1041 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggcctataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1042 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRAYNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1043 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcacaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1044 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1045 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtgtacgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcgttctttaaccagctgaaatggctggttaatccttccgcgccaaccaccattgcggcgcgggaaagcgcctatccgctgaagtttgatctgcaaaacacgcaaacggcgtaa

SEQ ID NO: 1046 - protein, 764 aa, Artificial Sequence
  Penicillin-G Acylates Variant from K. citrophila
SNMWVIGKNKAQDAKAIMVNGPQYGWCTPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAFFNQLKWLVNPSAPTTIAARESAYPLKFDLQNTQTA

SEQ ID NO: 1047 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1048 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1049 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctatggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccactgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1050 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRYSDSTSEIDNLALLTALKDKYGKQQGMAVFNQLKWLVNPSAPTTIAARESAYPLKFDLQNTQTA

SEQ ID NO: 1051 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgcggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1052 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNARIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1053 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtatctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1054 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRISDSTSEIDNLALLTALKDKYGKQQGMAVFNQLKWLVNPSAPTTIAARESAYPLKFDLQNTQTA

SEQ ID NO: 1055 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcagccggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattccattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcacctttgcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1056 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQPVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTFANRWSDSTSEIDNLALLTALKDKYGKQQGMAVFNQLKWLVNPSAPTTIAARESAYPLKFDLQNTQTA

SEQ ID NO: 1057 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggatagactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgtgtctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1058 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDRLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRVSDSTSEIDNLALLTALKDKYGKQQGMAVFNQLKWLVNPSAPTTIAARESAYPLKFDLQNTQTA

SEQ ID NO: 1059 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttactttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1060 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 1061 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtgtacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtcattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1062 - protein, 764 aa, Artificial Sequence
  Penicillin-G Acylates Variant from K. citrophila
SNMWVIGKNKAQDAKAIMVNGPQFGWYVPACTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRHSDSTSEIDNLALLTALKDKYGKQQGMAVFNQLKWLVNPSAPTTIAARESAYPLKFDLQNTQTA

SEQ ID NO: 1063 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1064 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1065 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaagccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttttcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1066 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKADTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFFAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1067 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataaccaggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1068 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNQALLTALKDKYGKQQGMAVFNQLKWLVNPSAPTTIAARESAYPLKFDLQNTQTA

SEQ ID NO: 1069 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaacactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1070 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVTLAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1071 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcatctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgttcacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1072 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1073 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgttaggcgcacgctgcacggcaacgtcattaaaaccgatactgcgacgcagaccgcctatgccaaagcgcgcgcctgggatggcgaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1074 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVRRTLHGNVIKTDTATQTAYAKARAWDGEEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1075 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaagatgtacgagagctttggccgtaaatcgctgtggttaacgccccaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccttagcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1076 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTLANRWSDSTSEIDNLALLTALKDKYGKQQGMAVFNQLKWLVNPSAPTTIAARESAYPLKFDLQNTQTA

SEQ ID NO: 1077 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttatggtgataaggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1078 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGYGDKVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1079 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcggcaacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1080 - protein, 764 aa, Artificial Sequence
  Penicillin-G Acylates Variant from K. citrophila
SNMWVIGKNKAQDAKAIMVNGPQFGWYVPAATYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1081 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaagggtgatcttgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1082 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGKGDLVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1083 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaagggtgataatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaccagatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1084 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGKGDNVDIFAEKLSAEKPGYYQHNGEWVKMLSRKETIAVKDGQPETFTVWRTLHGNVIKPDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1085 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtaccgttacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1086 - protein, 764 aa, Artificial Sequence
  Penicillin-G Acylates Variant from K. citrophila
SNMWVIGKNKAQDAKAIMVNGPQFGWYVPAYRYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1087 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccttgggtggtggtgatacagtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1088 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTLGGGDTVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1089 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatcatgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1090 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDHDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1091 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcggcagcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1092 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKAAAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1093 - DNA, 2295 bp, Artificial Sequence
  Penicillin-G Acylates Variant from K. citrophila
agcaatatgtgggtgattggcaaaaacaaagcccaggatgcgaaggccattatggtcaatgggtgtcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1094 - protein, 764 aa, Artificial Sequence
  Penicillin-G Acylates Variant from K. citrophila
SNMWVIGKNKAQDAKAIMVNGCQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1095 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttggggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1096 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVWGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1097 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgaaggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1098 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGEGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1099 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgagggtgatacggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1100 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGEGDTVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1101 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttggggtgatactgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1102 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGWGDTVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1103 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttggggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1104 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGWGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1105 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttggggtgattcggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1106 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGWGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1107 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgatggtgatcatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1108 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGDGDHVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1109 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgatggtgatatggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1110 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGDGDMVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1111 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgatggtgatcttgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1112 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGDGDLVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1113 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgagggtgatactgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggtgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1114 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGEGDTVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEVRHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1115 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1116 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGWGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1117 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgatggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1118 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGDGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1119 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgtatatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1120 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAYILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1121 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatatggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1122 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDMVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1123 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtattggtgatcaggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatagcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1124 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGIGDQVDIFAEKLSAEKPGYYQHNGEWVKMLSRKETIAVKDGQPETFTVWRTLHGNVIKTDTATQTAYAKARAWDSKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1125 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatcatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1126 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDHVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1127 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtgggcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1128 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPWAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1129 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtattggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggtgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1130 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGIGDDVDIFAEKLSAEKPGYYQHNGEWVKMLSRKETIAVKDGQPETFTVWRTLHGNVIKTDTATQTAYAKARAWDGKEVVSLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1131 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaatggtgatcaggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1132 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGNGDQVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1133 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaatggtgatgcggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1134 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGNGDAVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1135 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1136 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1137 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgttgacctacggtatcggcctgcacggcgcgggctatgacgtcaccggcaatacgccgtttgcctatccgggcctcatttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccaccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccgcccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataaccaggcgctgctgacggcgctaaaagacaaatacggcaagcagcagggcatggcggtctttaaccagctgaaatggctggttaatccttccgcgccaaccaccattgcggcgcgggaaggcgcctatccgctgaagtttgatctgcaaaacacgcaaacggcgtaa

SEQ ID NO: 1138 - protein, 764 aa, Artificial Sequence
  Penicillin-G Acylates Variant from K. citrophila
SNMWVIGKNKAQDAKAIMVNGPQFGWYVPALTYGIGLHGAGYDVTGNTPFAYPGLIFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATTNLAENDPRRQLVDKLASWDGENLVNDDGKTYQQPGSAILNAWLTSMLKRTVVAAVPAPFGKWYSASGYETAQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENNMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNQALLTALKDKYGKQQGMAVFNQLKWLVNPSAPTTIAAREGAYPLKFDLQNTQTA

SEQ ID NO: 1139 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaatggtgatgttgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactgcccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1140 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGNGDVVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDCPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1141 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatggggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1142 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1143 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacacaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1144 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1145 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtaatggtgattctgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1146 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGNGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1147 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatgaggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1148 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDEVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1149 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttatggtgatttggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1150 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGYGDLVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1151 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgattctgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1152 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1153 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcatggtgatgctgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1154 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGHGDAVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1155 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcttggtgatatggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1156 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGLGDMVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1157 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtactggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1158 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGTGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1159 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaaaggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1160 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPKGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1161 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgataatttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1162 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDNFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1163 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcagtttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1164 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFSFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1165 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagaaattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1166 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKEIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1167 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttccatttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1168 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFHFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1169 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatatgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1170 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDMFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1171 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccatatggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1172 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPYGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1173 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatcaattcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1174 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDQFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1175 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcacttaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1176 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAALKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1177 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttctatttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1178 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFYFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1179 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttctatggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1180 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFYGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1181 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1182 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1183 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgtgtattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1184 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALCINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1185 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacatggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1186 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSTWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1187 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggccgtacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1188 - protein, 764 aa, Artificial Sequence
  Penicillin-G Acylates Variant from K. citrophila
SNMWVIGKNKAQDAKAIMVNGPQYGWYAPAYTYGIGLHGAGYDVTGRTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1189 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgaaatggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1190 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSKWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1191 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgaggtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1192 - protein, 764 aa, Artificial Sequence
  Penicillin-G Acylates Variant from K. citrophila
SNMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSRWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1193 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1194 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1195 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaaaggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1196 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPKGSLNISVGAKILYEALQGDKSPIPQAVDLFGGKPQQEVILAALDDAWQTLSKRYGNDVTGWKTPAMALTFRANNFFGVPQAALKEARHQAEYQNRGTENNMIVFSPTSGNRPVLAWDVVAPGQSGFIAPDGKADKHYDDQLKMYESFGRKSTWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1197 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1198 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTGWKTPAMALTFRANNFFGVPQAALKEARHQAEYQNRGTENNMIVFSPTSGNRPVLAWDVVAPGQSGFIAPDGKADKHYDDQLKMYESFGRKSTWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1199 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaaaggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1200 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPKGSLNISVGAKILYEALQGDKSPIPQAVDLFGGKPQQEVILAALDDAWQTLSKRYGNDVTGWKTPAMALTFRANNFFGVPQAALKEARHQAEYQNRGTENNMIVFSPTSGNRPVLAWDVVAPGQSGFIAPDGKADKHYDDQLKMYESFGRKSTWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1201 - DNA, 2295 bp, Artificial Sequence; identical to SEQ ID NO: 1197
  Penicillin-G Acylates Variant from K. citrophila

SEQ ID NO: 1202 - protein, 764 aa, Artificial Sequence; identical to SEQ ID NO: 1198
  Penicillin-G Acylates Variant from K. citrophila

SEQ ID NO: 1203 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1204 - protein, 764 aa, Artificial Sequence; identical to SEQ ID NO: 1198
  Penicillin-G Acylates Variant from K. citrophila

SEQ ID NO: 1205 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1206 - protein, 764 aa, Artificial Sequence; identical to SEQ ID NO: 1198
  Penicillin-G Acylates Variant from K. citrophila

SEQ ID NO: 1207 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1208 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTGWKTPAMALTFRANNFFGVPQAALKEARHQAEYQNRGTENNMIVFSPTSGNRPVLAWDVVAPGQSGFIAPDGKADKHYDDQLKMYESFGRKSTWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1209 - DNA, 2295 bp, Artificial Sequence; identical to SEQ ID NO: 1205
  Penicillin-G Acylates Variant from K. citrophila

SEQ ID NO: 1210 - protein, 764 aa, Artificial Sequence; identical to SEQ ID NO: 1198
  Penicillin-G Acylates Variant from K. citrophila

SEQ ID NO: 1211 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatacgccggcgtatacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccatcaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagcgactgagatcgacacgatcctcgataagcaaccgcgcttcaccgccgatcaggcgtgggatgtgatccgccaaaccagccgtcgggatctcaacctgcggttgttcttaccggcgctgaaggacgccaccgccaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcactgaaagaggcgcgtcatcaggcggagtaccagaaccgcggtacggaaaacaacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1212 - protein, 764 aa, Artificial Sequence
  Penicillin-G Acylates Variant from K. citrophila
SLMWVIGKNKAQDAKAIMVNGPQYGWYTPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRATEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTGWKTPAMALTFRANNFFGVPQAALKEARHQAEYQNRGTENNMIVFSPTSGNRPVLAWDVVAPGQSGFIAPDGKADKHYDDQLKMYESFGRKSTWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1213 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1214 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1215 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1216 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1217 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1218 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1219 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcactgaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1220 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVWRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAALKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1221 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1222 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1223 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1224 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1225 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1226 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1227 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgtgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1228 - protein, 764 aa, Artificial Sequence; identical to SEQ ID NO: 1222
  Penicillin-G Acylates Variant from K. citrophila

SEQ ID NO: 1229 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1230 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1231 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaaaggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1232 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPKGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1233 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1234 - protein, 764 aa, Artificial Sequence; identical to SEQ ID NO: 1222
  Penicillin-G Acylates Variant from K. citrophila

SEQ ID NO: 1235 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1236 - protein, 764 aa, Artificial Sequence; identical to SEQ ID NO: 1218
  Penicillin-G Acylates Variant from K. citrophila

SEQ ID NO: 1237 - DNA, 2295 bp, Artificial Sequence; identical to SEQ ID NO: 1231
  Penicillin-G Acylates Variant from K. citrophila

SEQ ID NO: 1238 - protein, 764 aa, Artificial Sequence; identical to SEQ ID NO: 1232
  Penicillin-G Acylates Variant from K. citrophila

SEQ ID NO: 1239 - DNA, 2295 bp, Artificial Sequence; identical to SEQ ID NO: 1217
  Penicillin-G Acylates Variant from K. citrophila

SEQ ID NO: 1240 - protein, 764 aa, Artificial Sequence; identical to SEQ ID NO: 1218
  Penicillin-G Acylates Variant from K. citrophila

SEQ ID NO: 1241 - DNA, 2295 bp, Artificial Sequence; identical to SEQ ID NO: 1235
  Penicillin-G Acylates Variant from K. citrophila

SEQ ID NO: 1242 - protein, 764 aa, Artificial Sequence; identical to SEQ ID NO: 1218
  Penicillin-G Acylates Variant from K. citrophila

SEQ ID NO: 1243 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcactgaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1244 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAALKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1245 - DNA, 2295 bp, Artificial Sequence; identical to SEQ ID NO: 1243
  Penicillin-G Acylates Variant from K. citrophila

SEQ ID NO: 1246 - protein, 764 aa, Artificial Sequence; identical to SEQ ID NO: 1244
  Penicillin-G Acylates Variant from K. citrophila

SEQ ID NO: 1247 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgacctggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1248 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSTWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1249 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcgaagagactattgcggtcaaagacggccagccggagacctttaccgtttatcgcacgctgcacggcaacgtcattaaaaccgatgcggcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggtgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1250 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSREETIAVKDGQPETFTVYRTLHGNVIKTDAATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1251 - DNA, 2295 bp, Artificial Sequence
  Penicillin-G Acylates Variant from K. citrophila
agcttgatgtgggtgattggcaaaaacaaagccgcggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttatcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgaaatcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccacgtggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccaactggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtgatcgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaagatattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1252 - protein, 764 aa, Artificial Sequence
  Penicillin-G Acylates Variant from K. citrophila
SLMWVIGKNKAADAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVYRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPKSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPRGSLNISVGAKILYEALQGDKSPIPQAVDLFGGKPQQEVILAALDDAWQTLSKRYGNDVTNWKTPAMALTFRANNFFGVPQAAAKEARHQAEYQNRGTENDMIVFSPTSGDRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKDILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1253 - DNA, 2295 bp, Artificial Sequence
  Penicillin-G Acylates Variant from K. citrophila
agcttgatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgatgagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1254 - protein, 764 aa, Artificial Sequence
  Penicillin-G Acylates Variant from K. citrophila
SLMWVIGKNKAQDAKAIMVNGPQYGWYAPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDELLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1255 - DNA, 2295 bp, Artificial Sequence; identical to SEQ ID NO: 1159
  Penicillin-G Acylates Variant from K. citrophila

SEQ ID NO: 1256 - protein, 764 aa, Artificial Sequence; identical to SEQ ID NO: 1160
  Penicillin-G Acylates Variant from K. citrophila

SEQ ID NO: 1257 - DNA, 2295 bp, Artificial Sequence
  Penicillin-G Acylates Variant from K. citrophila
agcaatatgtgggtgattggcaaaaacaaagcccaggatgcgaaggccattatggtcaatggaccgcagtatggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcattgaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1258 - protein, 764 aa, Artificial Sequence; identical to SEQ ID NO: 1176
  Penicillin-G Acylates Variant from K. citrophila

SEQ ID NO: 1259 - DNA, 2295 bp, Artificial Sequence; identical to SEQ ID NO: 1185
  Penicillin-G Acylates Variant from K. citrophila

SEQ ID NO: 1260 - protein, 764 aa, Artificial Sequence; identical to SEQ ID NO: 1186
  Penicillin-G Acylates Variant from K. citrophila

SEQ ID NO: 1261 - DNA, 2295 bp, Artificial Sequence; identical to SEQ ID NO: 3
  Penicillin-G Acylates Variant from K. citrophila

SEQ ID NO: 1262 - protein, 764 aa, Artificial Sequence; identical to SEQ ID NO: 4
  Penicillin-G Acylates Variant from K. citrophila

SEQ ID NO: 1263 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgcgccggcgtacacctacggtatcggcctgcacggcgcgggctatgacgtcaccggcaatacgccgtttgcctatccgggcctcgtttttggtcacaacggcaccatttcatggggatccaccgccggttttggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggcaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtgatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcacaaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagataaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1264 - protein, 764 aa, Artificial Sequence
  Penicillin-G Acylates Variant from K. citrophila
SNMWVIGKNKAQDAKAIMVNGPQFGWYAPAYTYGIGLHGAGYDVTGNTPFAYPGLVFGHNGTISWGSTAGFGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHKESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1265 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttattctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1266 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRYSDSTSEIDNLALLTALKDKYGKQQGMAVFNQLKWLVNPSAPTTIAARESAYPLKFDLQNTQTA

SEQ ID NO: 1267 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtctgggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1268 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGLGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1269 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttgtggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1270 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1271 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcgtggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1272 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGRGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1273 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1274 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1275 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcatttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1276 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLIFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1277 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctgtttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1278 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1279 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1280 - protein, 764 aa, Artificial Sequence; identical to SEQ ID NO: 4
  Penicillin-G Acylates Variant from K. citrophila

SEQ ID NO: 1281 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctactggcgtttacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1282 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAFTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1283 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtggtggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1284 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1285 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcagggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggtcggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1286 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGQGDDVDIFAEKLSAEKPGYYQHNGEWVKMLSRKETIAVKDGQPETFTVWRTLHGNVIKTDTATQTAYAKARAWDGKEVASLLAWTHQMKAKNWSEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1287 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1288 - protein, 764 aa, Artificial Sequence; identical to SEQ ID NO: 1284
  Penicillin-G Acylates Variant from K. citrophila

SEQ ID NO: 1289 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1290 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1291 - DNA, 2295 bp, Artificial Sequence; identical to SEQ ID NO: 977
  Penicillin-G Acylates Variant from K. citrophila

SEQ ID NO: 1292 - protein, 764 aa, Artificial Sequence; identical to SEQ ID NO: 978
  Penicillin-G Acylates Variant from K. citrophila

SEQ ID NO: 1293 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgtcggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgtccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaagcgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1294 - protein, 764 aa, Artificial Sequence
  Penicillin-G Acylates Variant from K. citrophila
SNMWVIGKNKAQDAKAIMVNGPQAGWYVSAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLSSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTESDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1295 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcggcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgggggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1296 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYRQPGSAILNAWLTSMLKRTVVAAVPAPFGKWYSASGYETTQDGPTGSLNISGGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1297 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgcacacctacggtatcggcctgcacggcgcgggctatgacgtcaccggcaatacgccgtttgcctatccgggcctcatctttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttctctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1298 - protein, 764 aa, Artificial Sequence
  Penicillin-G Acylates Variant from K. citrophila
SNMWVIGKNKAQDAKAIMVNGPQAGWYVPAHTYGIGLHGAGYDVTGNTPFAYPGLIFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1299 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaaccgtaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggtaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1300 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLLFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANRNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1301 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcacatttggtcacaacggcaccatttcatggggatccaccgccggttgcggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgtgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctattccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1302 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLTFGHNGTISWGSTAGCGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1303 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcaggctggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtcttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1304 - protein, 764 aa, Artificial Sequence
  Penicillin-G Acylates Variant from K. citrophila
SNMWVIGKNKAQDAKAIMVNGPQAGWYVPAYTYGIGLHGAGYDVTGNTPFAYPGLVFGHNGTISWGSTAGLGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1305 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcctctttggtcacaacggcaccatttcatggggatccaccgccggttttggtgatggtgtcgatacctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1306 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLLFGHNGTISWGSTAGFGDGVDTFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1307 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttgttatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1308 - protein, 764 aa, Artificial Sequence
  Penicillin-G Acylates Variant from K. citrophila
SNMWVIGKNKAQDAKAIMVNGPQFGCYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1309 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctggaatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1310 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWNVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1311 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcacatttggtcacaacggcaccatttcatggggatccaccgccggttttggtgatggtgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgttggtctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1312 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLTFGHNGTISWGSTAGFGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRWSDSTSEIDNLALLTALKDKYGKQQGMAVFNQLKWLVNPSAPTTIAARESAYPLKFDLQNTQTA

SEQ ID NO: 1313 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1314 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1315 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1316 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1317 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1318 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1319 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1320 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1321 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1322 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1323 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1324 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1325 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1326 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1327 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1328 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1329 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1330 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1331 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1332 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1333 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1334 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1335 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1336 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1337 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1338 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1339 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1340 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1341 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1342 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1343 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1344 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1345 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1346 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1347 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1348 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1349 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1350 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1351 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1352 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1353 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1354 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1355 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1356 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1357 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1358 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1359 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1360 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1361 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1362 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1363 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1364 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1365 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1366 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1367 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacggaccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1368 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1369 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1370 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1371 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1372 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1373 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1374 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1375 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1376 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1377 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1378 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1379 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1380 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1381 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1382 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1383 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1384 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1385 - DNA, 2295 bp, Artificial Sequence; identical to SEQ ID NO: 1373
  Penicillin-G Acylates Variant from K. citrophila

SEQ ID NO: 1386 - protein, 764 aa, Artificial Sequence; identical to SEQ ID NO: 1374
  Penicillin-G Acylates Variant from K. citrophila

SEQ ID NO: 1387 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1388 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1389 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1390 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1391 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1392 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1393 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1394 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1395 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1396 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1397 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1398 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1399 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1400 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1401 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1402 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1403 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1404 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1405 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1406 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1407 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1408 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1409 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1410 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1411 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1412 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1413 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1414 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1415 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1416 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1417 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1418 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1419 - DNA, 2295 bp, Artificial Sequence; identical to SEQ ID NO: 1343
  Penicillin-G Acylates Variant from K. citrophila

SEQ ID NO: 1420 - protein, 764 aa, Artificial Sequence; identical to SEQ ID NO: 1344
  Penicillin-G Acylates Variant from K. citrophila

SEQ ID NO: 1421 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1422 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1423 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1424 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1425 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1426 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1427 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1428 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1429 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1430 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1431 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1432 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1433 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgtcatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1434 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPVMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1435 - DNA, 2295 bp, Artificial Sequence; identical to SEQ ID NO: 1383
  Penicillin-G Acylates Variant from K. citrophila

SEQ ID NO: 1436 - protein, 764 aa, Artificial Sequence; identical to SEQ ID NO: 1384
  Penicillin-G Acylates Variant from K. citrophila

SEQ ID NO: 1437 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1438 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1439 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1440 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1441 - DNA, 2295 bp, Artificial Sequence; identical to SEQ ID NO: 1423
  Penicillin-G Acylates Variant from K. citrophila

SEQ ID NO: 1442 - protein, 764 aa, Artificial Sequence; identical to SEQ ID NO: 1424
  Penicillin-G Acylates Variant from K. citrophila

SEQ ID NO: 1443 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1444 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1445 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1446 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1447 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1448 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1449 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1450 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1451 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1452 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1453 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1454 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1455 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1456 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1457 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1458 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1459 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttgggttgatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1460 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGLIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1461 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1462 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1463 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1464 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1465 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1466 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1467 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1468 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1469 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1470 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1471 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1472 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1473 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1474 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1475 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgctggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1476 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1477 - DNA, 2295 bp, Artificial Sequence; identical to SEQ ID NO: 1421
  Penicillin-G Acylates Variant from K. citrophila

SEQ ID NO: 1478 - protein, 764 aa, Artificial Sequence; identical to SEQ ID NO: 1422
  Penicillin-G Acylates Variant from K. citrophila

SEQ ID NO: 1479 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1480 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1481 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1482 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1483 - DNA, 2295 bp, Artificial Sequence; identical to SEQ ID NO: 1395
  Penicillin-G Acylates Variant from K. citrophila

SEQ ID NO: 1484 - protein, 764 aa, Artificial Sequence; identical to SEQ ID NO: 1396
  Penicillin-G Acylates Variant from K. citrophila

SEQ ID NO: 1485 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1486 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1487 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1488 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1489 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1490 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1491 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1492 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1493 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1494 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1495 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1496 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1497 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1498 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1499 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1500 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1501 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1502 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1503 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1504 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1505 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1506 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1507 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1508 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1509 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgtggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1510 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIVVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1511 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1512 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1513 - DNA, 2295 bp, Artificial Sequence; identical to SEQ ID NO: 1337
  Penicillin-G Acylates Variant from K. citrophila

SEQ ID NO: 1514 - protein, 764 aa, Artificial Sequence; identical to SEQ ID NO: 1338
  Penicillin-G Acylates Variant from K. citrophila

SEQ ID NO: 1515 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1516 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1517 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgctggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1518 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1519 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgctggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1520 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1521 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1522 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1523 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1524 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1525 - DNA, 2295 bp, Artificial Sequence; identical to SEQ ID NO: 1397
  Penicillin-G Acylates Variant from K. citrophila

SEQ ID NO: 1526 - protein, 764 aa, Artificial Sequence; identical to SEQ ID NO: 1398
  Penicillin-G Acylates Variant from K. citrophila

SEQ ID NO: 1527 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatggcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1528 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDGVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1529 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1530 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1531 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaacgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1532 - protein, 764 aa, Artificial Sequence; identical to SEQ ID NO: 1492
  Penicillin-G Acylates Variant from K. citrophila

SEQ ID NO: 1533 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1534 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1535 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1536 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1537 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1538 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1539 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1540 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1541 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1542 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1543 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1544 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1545 - DNA, 2295 bp, Artificial Sequence; identical to SEQ ID NO: 1407
  Penicillin-G Acylates Variant from K. citrophila

SEQ ID NO: 1546 - protein, 764 aa, Artificial Sequence; identical to SEQ ID NO: 1408
  Penicillin-G Acylates Variant from K. citrophila

SEQ ID NO: 1547 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1548 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1549 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1550 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1551 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatccggtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1552 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDPVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1553 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtggggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1554 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1555 - DNA, 2295 bp, Artificial Sequence; identical to SEQ ID NO: 1389
  Penicillin-G Acylates Variant from K. citrophila

SEQ ID NO: 1556 - protein, 764 aa, Artificial Sequence; identical to SEQ ID NO: 1390
  Penicillin-G Acylates Variant from K. citrophila

SEQ ID NO: 1557 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggtatgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1558 - protein, 764 aa, Artificial Sequence
  Penicillin-G Acylates Variant from K. citrophila
SNMWVIGKNKAQDAKAIMVNGPQFGWYVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1559 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1560 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1561 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatagcgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgttcgcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggttgcatttacagcgccagtggctatgaaaccacccagaaagggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1562 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDSVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLFAFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGCIYSASGYETTQKGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1563 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttaacgcctggctgaccagcatgctcaagcgcacggtggttgccgcggtcccagcgccgtttggtaagatttacagcgccagtggctatgaaaccacccagtttgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1564 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILNAWLTSMLKRTVVAAVPAPFGKIYSASGYETTQFGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1565 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1566 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1567 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccaggacgggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1568 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQDGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1569 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatctgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagatttacagcgccagtggctatgaaaccacccagaaagggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1570 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDLWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKIYSASGYETTQKGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1571 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgataacgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgttcggcttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggttgcatttacagcgccagtggctatgaaaccacccaggacgggccaaccggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1572 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDNVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVFGFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGCIYSASGYETTQDGPTGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1573 - DNA, 2295 bp, Artificial Sequence
  Penicillin-G Acylates Variant from K. citrophila
agcaatatgtgggtgattggcaaaaacaaagcccaggatgcgaaggccattatggtcaatgggccgcagtttggttggaccgtgccggcgtacacctacggtatcggcctgcacggcgcgggctatgacgtcaccggcaatacgccgtttgcctatccgggcctcgtttttggtcacaacggcaccatttcatggggatccaccgccggtgggggtgatgatgtcgatatctttgccgaaaaactttccgccgagaagccgggctattaccagcataacggcgagtgggtgaagatgttgagccgcaaggagactattgcggtcaaagacggccagccggagacctttaccgtttggcgcacgctgcacggcaacgtcattaaaaccgatactgcgacgcagaccgcctatgccaaagcgcgcgcctgggatggcaaagaggtggcgtccctgctggcgtggacgcaccagatgaaggccaaaaactggccggagtggacgcagcaggcggccaaacaggcgctgaccattaactggtactacgccgatgtgaacggcaatatcggctatgtgcataccggcgcctatccggatcgccagcccggccacgacccgcgtttgccggttcccggcactggaaaatgggactggaaagggttgctgtcgtttgatttgaatccgaaagtgtataacccgcagtcgggctatatcgccaactggaacaactcgccgcaaaaagactacccggcctctgatgtgtgggcgttcctgtggggcggtgcggatcgagttactgagatcgacacgatcctcgataagcaaccgcgcttcaccgccgatcaggcgtgggatgtgatccgccaaaccagccgtcgggatctcaacctgcggttgttcttaccggcgctgaaggacgccaccgcgaacctggcggaaaacgatccgcgccgccaactggtggataaactggcgagctgggacggcgaaaaccttgtcaacgatgacggaaaaacctatcagcaaccgggatcggcgattcttcgtgcctggctgaccagcatgctcaagcgcacggtggttgccgcggtcccagcgccgtttggtaagtggtacagcgccagtggctatgaaaccacccagtgggggccaccgggctcgctgaacatcagcgtgggggcgaaaatcctctacgaagctctgcagggtgataagtcgccaatcccgcaggcggtcgatctgtttggcgggaaaccgcagcaggaagtaatactggcggcgctggacgacgcttggcagacgctgtcaaaacgctacggtaacgacgtcaccggctggaaaacccctgccatggcgcttaccttccgggccaataacttcttcggcgtgccgcaggcggcagcaaaagaggcgcgtcatcaggcggagtaccagaaccgcggtacggaaaacgacatgattgtcttctcaccgacgtcgggtaaccgcccggttcttgcctgggatgtggtggcgccggggcaaagcggttttatcgcgccggatggcaaagccgataagcactatgacgatcagctgaaaatgtacgagagctttggccgtaaatcgctgtggttaacgcctcaggacgttgacgagcaccaagagtctcaggaagtgctgcaggtacagttggatcagaccgaggttaagatcgttcgcgatgaatacggcatgccgcatatttacgccgatgatacctatcgactgttttacggctatggctacgtggtggcgcaggatcgcctgttccagatggaaatggcgcgccgcagtactcaggggaccgtctccgaggtgctgggcaaagcattcgtcagttttgataaagatattcgccagaactactggccggattctattcgcgcgcagatagcttccctctccgctgaggataaatccattctgcagggctatgccgatggcatgaatgcgtggatcgataaagtgaacgccagccccgataagctgttaccccagcagttctccacctttggttttaaacccaagcattgggaaccgtttgatgtggcgatgatttttgtcggcaccatggcgaaccgtttctctgacagcaccagcgaaattgataacctggcgctgctgacggcgctaaaagacaaatacggcaagcagcagggcatggcggtctttaaccagctgaaatggctggttaatccttccgcgccaaccaccattgcggcgcgggaaagcgcctatccgctgaagtttgatctgcaaaacacgcaaacggcgtaa

SEQ ID NO: 1574 - protein, 764 aa, Artificial Sequence
  Penicillin-G Acylates Variant from K. citrophila
SNMWVIGKNKAQDAKAIMVNGPQFGWTVPAYTYGIGLHGAGYDVTGNTPFAYPGLVFGHNGTISWGSTAGGGDDVDIFAEKLSAEKPGYYQHNGEWVKMLSRKETIAVKDGQPETFTVWRTLHGNVIKTDTATQTAYAKARAWDGKEVASLLAWTHQMKAKNWPEWTQQAAKQALTINWYYADVNGNIGYVHTGAYPDRQPGHDPRLPVPGTGKWDWKGLLSFDLNPKVYNPQSGYIANWNNSPQKDYPASDVWAFLWGGADRVTEIDTILDKQPRFTADQAWDVIRQTSRRDLNLRLFLPALKDATANLAENDPRRQLVDKLASWDGENLVNDDGKTYQQPGSAILRAWLTSMLKRTVVAAVPAPFGKWYSASGYETTQWGPPGSLNISVGAKILYEALQGDKSPIPQAVDLFGGKPQQEVILAALDDAWQTLSKRYGNDVTGWKTPAMALTFRANNFFGVPQAAAKEARHQAEYQNRGTENDMIVFSPTSGNRPVLAWDVVAPGQSGFIAPDGKADKHYDDQLKMYESFGRKSLWLTPQDVDEHQESQEVLQVQLDQTEVKIVRDEYGMPHIYADDTYRLFYGYGYVVAQDRLFQMEMARRSTQGTVSEVLGKAFVSFDKDIRQNYWPDSIRAQIASLSAEDKSILQGYADGMNAWIDKVNASPDKLLPQQFSTFGFKPKHWEPFDVAMIFVGTMANRFSDSTSEIDNLALLTALKDKYGKQQGMAVFNQLKWLVNPSAPTTIAARESAYPLKFDLQNTQTA

SEQ ID NO: 1575 - DNA, 2295 bp, Artificial Sequence; identical to SEQ ID NO: 1427
  Penicillin-G Acylates Variant from K. citrophila

SEQ ID NO: 1576 - protein, 764 aa, Artificial Sequence; identical to SEQ ID NO: 1428
  Penicillin-G Acylates Variant from K. citrophila

(The sequence listing continues in the following parts.)

What is claimed is:

1. An engineered penicillin G acylase having a polypeptide sequence that is at least 95% identical to SEQ ID NO: 1220, wherein said penicillin G acylase comprises a leucine residue at position X2 as compared to the sequence of SEQ ID NO: 1220.

2. The engineered penicillin G acylase of claim 1, wherein said penicillin G acylase comprises SEQ ID NO: 1194.

3. The engineered penicillin G acylase of claim 1, wherein said penicillin G acylase is capable of producing phenyl acetate mono-protected or di-protected insulin.

4. The engineered penicillin G acylase of claim 1, wherein said penicillin G acylase comprises a polypeptide sequence that is at least 95% identical to at least one sequence provided in the even-numbered sequences of SEQ ID NOS: 6-1902.

5. The engineered penicillin G acylase of claim 1, wherein said penicillin G acylase is encoded by a polynucleotide sequence that is at least 95% identical to SEQ ID NO:1219.

6. A method for producing phenyl acetate mono-protected insulin, comprising: i) providing the engineered penicillin G acylase of claim 1 and/or a composition comprising said engineered penicillin G acylase, and insulin comprising A1/B1/B29 tri-phenyl acetate protecting groups; and ii) exposing said engineered penicillin G acylase to said insulin comprising A1/B1/B29 tri-phenyl acetate protecting groups, under conditions such that said engineered penicillin G acylase removes the A1, B1 and/or B29 tri-phenyl acetate protecting groups from said insulin thereby producing phenyl acetate mono-protected or di-protected insulin.

7. The method of claim 6, wherein said penicillin G acylase removes the A1 tri-phenyl acetate protecting group of said insulin.

8. The method of claim 6, wherein said penicillin G acylase removes the B1 tri-phenyl acetate protecting group of said insulin.

9. The method of claim 6, wherein said penicillin G acylase removes the B29 tri-phenyl acetate protecting group of said insulin.

10. The method of claim 6, wherein said penicillin G acylase removes the A1, B1, and B29 tri-phenyl acetate protecting group of said insulin.

11. The method of claim 6, wherein said engineered penicillin G acylase produces more than 90% phenyl acetate mono-protected, as compared to the production of phenyl acetate mono-protected insulin by the polypeptide of SEQ ID NO:2.

12. The engineered penicillin G acylase of claim 1, wherein said penicillin G acylase comprises SEQ ID NO: 1220.

* * * * *